United States Patent 9,782,462 (MODIFIED POLYNUCLEOTIDES FOR THE PRODUCTION OF PROTEINS ASSOCIATED WITH HUMAN DISEASE) - sequence listing, part 28

SEQ ID NO: 31326 - DNA, 2565 bp, Homo sapiens
ttaaatttagaggtcaaattcaaaaaaatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttatttttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcacttt

SEQ ID NO: 31327 - DNA, 2782 bp, Homo sapiens
attggctgcccggccccctttgttcccgggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttatttttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaa

SEQ ID NO: 31328 - DNA, 2763 bp, Homo sapiens
aataaataggaggttttgagggctgtttatgagcgcattccattacagtgtctttcagcggagccagagctcagccaatcctaattaagaagcaatttcagctgcagtcattgcttattataataattgtgacatttttatagccctacattgtctttctcaaagtaacggattcaggaggagtccttttctgagtagagtccacagaagaggtattctattgatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttatttttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaa

SEQ ID NO: 31329 - DNA, 1022 bp, Homo sapiens
actgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagtcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttgg

SEQ ID NO: 31330 - DNA, 1018 bp, Homo sapiens
atgggggcgaggcagatccagaccagctcctcccagacctctccagaagaagccatgggaacccctcgtatccagcatttgctgatcctcctggtcctaggagcctccctcctgacctcgggcctagagctgtattgtcaaaagggtctgtccatgactgtggaagcagatccagccaatatgtttaactggaccacagaggaagtggagacttgtgacaaaggggcactttgccaggaaaccatactaataattaaagcagggactgagacagccattttggccacgaagggctgcatcccggaaggggaggaggccataacaattgtccagcactcttcacctcccggcctgatcgtgacctcctacagtaactactgtgaggattccttctgtaatgacaaagacagcctgtctcagttttgggagttcagtgagaccacagcttccactgtgtcaacaaccctccattgtccaacctgtgtggctttggggacctgtttcagtgctccttctcttccctgtcccaatggtacaactcgatgctatcaaggaaaacttgagatcactggaggtggcattgagtcgtctgtggaggtcaaaggctgtacagccatgattggctgcaggctgatgtctggaatcttagcagtaggacccatgtttgtgagggaagcgtgcccacatcagctgctcactcaacctcgaaagactgaaaatggggccacctgtcttcccattcctgtttgggggttacagctactgctgccattgctgctgccatcatttattcacttttcctaagaaggcacttctgggcctgggtctgaggacatcttttttgactgggagccttcttactgttgaggttcaacaagctgaggagtagatgggaatttgagggagaatacagagatactatgaacgtatttgacatttttaatacaatttctgctataatttttgtatgcagtaggcgttactaataaacatttctgctgtgatttgtgtatgtttc

SEQ ID NO: 31331 - DNA, 1159 bp, Homo sapiens
gcgtcgtaagagaatgccaagcccggggagaaggcgttccgggcctcaactttggcgtcgtgagattcttgtgaggcgtctgcctggaagccggcagcaattttgcttctttaaagagaaaaagaaggctagggactcagattcctggattctgagatccagaccagctcctcccagacctctccagaagaagccatgggaacccctcgtatccagcatttgctgatcctcctggtcctaggagcctccctcctgacctcgggcctagagctgtattgtcaaaagggtctgtccatgactgtggaagcagatccagccaatatgtttaactggaccacagaggaagtggagacttgtgacaaaggggcactttgccaggaaaccatactaataattaaagcagggactgagacagccattttggccacgaagggctgcatcccggaaggggaggaggccataacaattgtccagcactcttcacctcccggcctgatcgtgacctcctacagtaactactgtgaggattccttctgtaatgacaaagacagcctgtctcagttttgggagttcagtgagaccacagcttccactgtgtcaacaaccctccattgtccaacctgtgtggctttggggacctgtttcagtgctccttctcttccctgtcccaatggtacaactcgatgctatcaaggaaaacttgagatcactggaggtggcattgagtcgtctgtggaggtcaaaggctgtacagccatgattggctgcaggctgatgtctggaatcttagcagtaggacccatgtttgtgagggaagcgtgcccacatcagctgctcactcaacctcgaaagactgaaaatggggccacctgtcttcccattcctgtttgggggttacagctactgctgccattgctgctgccatcatttattcacttttcctaagaaggcacttctgggcctgggtctgaggacatcttttttgactgggagccttcttactgttgaggttcaacaagctgaggagtagatgggaatttgagggagaatacagagatactatgaacgtatttgacatttttaatacaatttctgctataatttttgtatgcagtaggcgttactaataaacatttctgctgtgatttgtgtatgtttc

SEQ ID NO: 31332 - DNA, 1112 bp, Homo sapiens
gaaggcgttccgggcctcaactttggcgtcgtgagattcttgtgaggcgtctgcctggaagccggcagcaattttgcttctttaaagagaaaaagaaggctagggactcagattcctggattctgagatccagaccagctcctcccagacctctccagaagaagccatgggaacccctcgtatccagcatttgctgatcctcctggtcctaggagcctccctcctgacctcgggcctagagctgtattgtcaaaagggtctgtccatgactgtggaagcagatccagccaatatgtttaactggaccacagaggaagtggagacttgtgacaaaggggcactttgccaggaaaccatactaataattaaagcagggactgagacagccattttggccacgaagggctgcatcccggaaggggaggaggccataacaattgtccagcactcttcacctcccggcctgatcgtgacctcctacagtaactactgtgaggattccttctgtaatgacaaagacagcctgtctcagttttgggagttcagtgagaccacagcttccactgtgtcaacaaccctccattgtccaacctgtgtggctttggggacctgtttcagtgctccttctcttccctgtcccaatggtacaactcgatgctatcaaggaaaacttgagatcactggaggtggcattgagtcgtctgtggaggtcaaaggctgtacagccatgattggctgcaggctgatgtctggaatcttagcagtaggacccatgtttgtgagggaagcgtgcccacatcagctgctcactcaacctcgaaagactgaaaatggggccacctgtcttcccattcctgtttgggggttacagctactgctgccattgctgctgccatcatttattcacttttcctaagaaggcacttctgggcctgggtctgaggacatcttttttgactgggagccttcttactgttgaggttcaacaagctgaggagtagatgggaatttgagggagaatacagagatactatgaacgtatttgacatttttaatacaatttctgctataatttttgtatgcagtaggcgttactaataaacatttctgct

SEQ ID NO: 31333 - DNA, 1446 bp, Homo sapiens
aaccatccatcccatcagggaaatatgcaacatgcttcaaagaataagaagagaactttgggccagtagagacggggtttcaccgtgttagccaggatggtctcgatctcctgacctcgtgatccgcctgccttggcctcccaaagtgctgggattacagggcactgaatgtcaaagtgaaggaattcaatgaagcccggatcaagggcaggagcaaccgtgaccctcttaaaagagccaatgccccatgtaattagtgacgcgcgcgaatggatagacgctattcccaccgtccctacatagcatccagcgacaccacagccaagggacaggcttggcggaacctgcgggagagaagaaccctctgagcctgattgaaaggcggtgaagagacaggagagggggatcggtgggcggtcccgcctccatcttcagttcccgcatgggggcgaggcagatccagaccagctcctcccagacctctccagaagaagccatgggaacccctcgtatccagcatttgctgatcctcctggtcctaggagcctccctcctgacctcgggcctagagctgtattgtcaaaagggtctgtccatgactgtggaagcagatccagccaatatgtttaactggaccacagaggaagtggagacttgtgacaaaggggcactttgccaggaaaccatactaataattaaagcagggactgagacagccattttggccacgaagggctgcatcccggaaggggaggaggccataacaattgtccagcactcttcacctcccggcctgatcgtgacctcctacagtaactactgtgaggattccttctgtaatgacaaagacagcctgtctcagttttgggagttcagtgagaccacagcttccactgtgtcaacaaccctccattgtccaacctgtgtggctttggggacctgtttcagtgctccttctcttccctgtcccaatggtacaactcgatgctatcaaggaaaacttgagatcactggaggtggcattgagtcgtctgtggaggtcaaaggctgtacagccatgattggctgcaggctgatgtctggaatcttagcagtaggacccatgtttgtgagggaagcgtgcccacatcagctgctcactcaacctcgaaagactgaaaatggggccacctgtcttcccattcctgtttgggggttacagctactgctgccattgctgctgccatcatttattcacttttcctaagaaggcacttctgggcctgggtctgaggacatcttttttgactgggagccttcttactgttgaggttcaacaagctgaggagtagatgggaatttgagggagaatacagagatactatgaacgtatttgacatttttaatacaatttctgctataatttttgtatgcagtaggcgttactaataaacatttctgctgtga

SEQ ID NO: 31334 - DNA, 2977 bp, Homo sapiens
atgatctcggctcactgcaacctccgcctcctgtgttcaagcgattcttctgcctcagcctcccaagtagctgggactacagaagttgttgaaaacctggttacaaatgataattcacctaacataccagaggcaattgatagactcttcagcgacatagcaaatatcaacagggagtctatggctgaaataacagacattcagattgaagaaatggcagtaaacctatggaactgggcacttaccataggaggaggttggcttgtaaatgaagagcagaaaattagattacattatgttgcttgcaagttgctgagtatgtgtgaagcctcatttgcctcagaacaaagtattcaacgactgattatgatgaatatgagaataggaaaagaatggttggatgctggaaattttctaatcgctgatgaatgttttcaagctgctgtggccagtctggagcaattatacgtcaaattaattcaaaggagctcccctgaggctgacttgaccatggagaagattactgttgagagtgaccacttcagagtgctttcttaccaagcagagtcagcagttgctcaaggggattttcaaagagcatctatgtgtgtactgcaatgtaaagatatgttgatgaggctcccccagatgacttcaagtcttcatcatctctgttacaactttggagtagaaacccagaagaataataaatatgaagaaagttctttctggcttagccaaagctatgatattgggaagatggataagaaatctactgggccagaaatgctggctaaagttctacggctattagccacgaattatttggattgggatgacaccaaatattatgataaggctctcaatgctgtaaacctagcaaacaaggaacatttaagttctcctgggcttttcttaaaaatgaaaatcctcttgaaaggcgaaacatctaatgaagaactccttgaagctgtcatggaaatactacatcttgacatgcccttagacttctgtctgaacattgctaaactgctgatggatcatgaaagagaatctgttgggtttcatttcctgacgattattcatgaacgttttaagtcatcggaaaatattggaaaagttctgatactccatactgacatgcttttacaaaggaaggaagaacttcttgccaaggagaagattgaagaaatctttttagctcaccaaacaggaagacaactgacagcagaatcaatgaactggttacacaacattctgtggagacaagctgccagtagttttgaggtacaaaattacactgatgccctacaatggtactattattctctgaggttttattcaactgatgaaatggatctggacttcaccaagctgcagaggaacatggcttgctgttacctgaatttgcaacaacttgataaggccaaagaggcagtggcagaagctgaacgacatgaccctaggaacgttttcactcaattttatatattcaagattgcagtcatagagggcaactctgaaagagctttgcaggcaataattactttagagaatatattaacagatgaagagtcagaagataatgatctagttgcagagagaggttcacctaccatgcttctaagtttagctgcccagtttgctctagagaatggacaacaaattgtggcagaaaaagctttggaatatttagctcaacattcagaagaccaggaacaagttcttacagctgtaaagtgtttgcttcgttttcttcttccaaaaattgctgaaatgccggaatctgaagataagaagaaagaaatggatcgacttttgacttgcctgaatagagcctttgtgaaactttctcagccttttggtgaagaagccttaagtttggagtcaagagctaatgaagctcagtggtttcgaaaaacagcttggaacttggctgtgcaatgtgacaaagatccagtgatgatgagagagttttttatactttcttataagatgtcccagttttgtccttctgatcaagtaattctgattgcacggaaaacatgtttacttatggcagttgcagttgatctagagcaagggagaaaagcttcaacagcttttgaacagaccatgttcctgagtcgtgcacttgaggagatccagacatgcaatgacatccataatttcctgaaacaaacagggaccttctcaaatgattcatgtgagaaattgcttctgctgtacgagtttgaagttagagccaaattgaatgatccattactggaaagcttcctggaatcagtgtgggagttgcctcatttagaaactaaaacttttgaaacaattgcaataatagcaatggaaaagcctgcacactatcctttgattgctctcaaggccttgaaaaaggctttattgctctacaaaaaggaagaaccaattgatatatcacaatacagcaaatgtatgcacaacttggttaacctctcagtgccagatggggcgtcgaatgtagagctctgtcccctggaagaagtttggggctattttgaagatgctctgagccacattagccgcactaaagactacccagaaatggagattctctggctgatggtcaagtcctggaataccggagtacttatgtttagcaggagcaagtatgcatctgctgaaaagtggtgtggcctggccttgcgtttccttaaccaccttacctccttcaaggaaagctatgaaactcagatgaatatgctgtatagtcagcttgtggaagcattgagtaacaacaagggcccagtttttcatgaacatggctactggagcaagtcagattaggcaagctcatggccacatgaagaagatacattgtcccgagatgctgactgtttaaatttttgccagagtttctcttgagcttttgtttctgtttgctcagaccctgttttcatgttgttgaataaactttctaaaataaaagcatgctgaattt

SEQ ID NO: 31335 - DNA, 2224 bp, Homo sapiens
agtatcacctcagcatacacagattgaaaaatgttagaaaccaggaagacaactctacttttttgcattgggggaataaacaaaccaactaaccaactaaaataatacacttactccaactaagacaacataggaagaccagagagatgattggagtcaccaagttgaagtacattagtttgggatgataattccttatgacagtgtttatccaaatctgtcatggaaatactacatcttgacatgcccttagacttctgtctgaacattgctaaactgctgatggatcatgaaagagaatctgttgggtttcatttcctgacgattattcatgaacgttttaagtcatcggaaaatattggaaaagttctgatactccatactgacatgcttttacaaaggaaggaagaacttcttgccaaggagaagattgaagaaatctttttagctcaccaaacaggaagacaactgacagcagaatcaatgaactggttacacaacattctgtggagacaagctgccagtagttttgaggtacaaaattacactgatgccctacaatggtactattattctctgaggttttattcaactgatgaaatggatctggacttcaccaagctgcagaggaacatggcttgctgttacctgaatttgcaacaacttgataaggccaaagaggcagtggcagaagctgaacgacatgaccctaggaacgttttcactcaattttatatattcaagattgcagtcatagagggcaactctgaaagagctttgcaggcaataattactttagagaatatattaacagatgaagagtcagaagataatgatctagttgcagagagaggttcacctaccatgcttctaagtttagctgcccagtttgctctagagaatggacaacaaattgtggcagaaaaagctttggaatatttagctcaacattcagaagaccaggaacaagttcttacagctgtaaagtgtttgcttcgttttcttcttccaaaaattgctgaaatgccggaatctgaagataagaagaaagaaatggatcgacttttgacttgcctgaatagagcctttgtgaaactttctcagccttttggtgaagaagccttaagtttggagtcaagagctaatgaagctcagtggtttcgaaaaacagcttggaacttggctgtgcaatgtgacaaagatccagtgatgatgagagagttttttatactttcttataagatgtcccagttttgtccttctgatcaagtaattctgattgcacggaaaacatgtttacttatggcagttgcagttgatctagagcaagggagaaaagcttcaacagcttttgaacagaccatgttcctgagtcgtgcacttgaggagatccagacatgcaatgacatccataatttcctgaaacaaacagggaccttctcaaatgattcatgtgagaaattgcttctgctgtacgagtttgaagttagagccaaattgaatgatccattactggaaagcttcctggaatcagtgtgggagttgcctcatttagaaactaaaacttttgaaacaattgcaataatagcaatggaaaagcctgcacactatcctttgattgctctcaaggccttgaaaaaggctttattgctctacaaaaaggaagaaccaattgatatatcacaatacagcaaatgtatgcacaacttggttaacctctcagtgccagatggggcgtcgaatgtagagctctgtcccctggaagaagtttggggctattttgaagatgctctgagccacattagccgcactaaagactacccagaaatggagattctctggctgatggtcaagtcctggaataccggagtacttatgtttagcaggagcaagtatgcatctgctgaaaagtggtgtggcctggccttgcgtttccttaaccaccttacctccttcaaggaaagctatgaaactcagatgaatatgctgtatagtcagcttgtggaagcattgagtaacaacaagggcccagtttttcatgaacatggctactggagcaagtcagattaggcaagctcatggccacatgaagaagatacattgtcccgagatgctgactgtttaaatttttgccagagtttctcttgagcttttgtttctgtttgctcagaccctgttttcatgttgttgaataaactttctaaaataaaagcatgctgaattt

SEQ ID NO: 31336 - DNA, 3032 bp, Homo sapiens
ggagttttctgaacgtcctcgtgcgctgtggacggaggttgtggagagagcagggcggcattggtggctgcggctgaggcttgagccagagatttaaaaatggacaatgatgattttttttccatggactttaaagaagttgttgaaaacctggttacaaatgataattcacctaacataccagaggcaattgatagactcttcagcgacatagcaaatatcaacagggagtctatggctgaaataacagacattcagattgaagaaatggcagtaaacctatggaactgggcacttaccataggaggaggttggcttgtaaatgaagagcagaaaattagattacattatgttgcttgcaagttgctgagtatgtgtgaagcctcatttgcctcagaacaaagtattcaacgactgattatgatgaatatgagaataggaaaagaatggttggatgctggaaattttctaatcgctgatgaatgttttcaagctgctgtggccagtctggagcaattatacgtcaaattaattcaaaggagctcccctgaggctgacttgaccatggagaagattactgttgagagtgaccacttcagagtgctttcttaccaagcagagtcagcagttgctcaaggggattttcaaagagcatctatgtgtgtactgcaatgtaaagatatgttgatgaggctcccccagatgacttcaagtcttcatcatctctgttacaactttggagtagaaacccagaagaataataaatatgaagaaagttctttctggcttagccaaagctatgatattgggaagatggataagaaatctactgggccagaaatgctggctaaagttctacggctattagccacgaattatttggattgggatgacaccaaatattatgataaggctctcaatgctgtaaacctagcaaacaaggaacatttaagttctcctgggcttttcttaaaaatgaaaatcctcttgaaaggcgaaacatctaatgaagaactccttgaagctgtcatggaaatactacatcttgacatgcccttagacttctgtctgaacattgctaaactgctgatggatcatgaaagagaatctgttgggtttcatttcctgacgattattcatgaacgttttaagtcatcggaaaatattggaaaagttctgatactccatactgacatgcttttacaaaggaaggaagaacttcttgccaaggagaagattgaagaaatctttttagctcaccaaacaggaagacaactgacagcagaatcaatgaactggttacacaacattctgtggagacaagctgccagtagttttgaggtacaaaattacactgatgccctacaatggtactattattctctgaggttttattcaactgatgaaatggatctggacttcaccaagctgcagaggaacatggcttgctgttacctgaatttgcaacaacttgataaggccaaagaggcagtggcagaagctgaacgacatgaccctaggaacgttttcactcaattttatatattcaagattgcagtcatagagggcaactctgaaagagctttgcaggcaataattactttagagaatatattaacagatgaagagtcagaagataatgatctagttgcagagagaggttcacctaccatgcttctaagtttagctgcccagtttgctctagagaatggacaacaaattgtggcagaaaaagctttggaatatttagctcaacattcagaagaccaggaacaagttcttacagctgtaaagtgtttgcttcgttttcttcttccaaaaattgctgaaatgccggaatctgaagataagaagaaagaaatggatcgacttttgacttgcctgaatagagcctttgtgaaactttctcagccttttggtgaagaagccttaagtttggagtcaagagctaatgaagctcagtggtttcgaaaaacagcttggaacttggctgtgcaatgtgacaaagatccagtgatgatgagagagttttttatactttcttataagatgtcccagttttgtccttctgatcaagtaattctgattgcacggaaaacatgtttacttatggcagttgcagttgatctagagcaagggagaaaagcttcaacagcttttgaacagaccatgttcctgagtcgtgcacttgaggagatccagacatgcaatgacatccataatttcctgaaacaaacagggaccttctcaaatgattcatgtgagaaattgcttctgctgtacgagtttgaagttagagccaaattgaatgatccattactggaaagcttcctggaatcagtgtgggagttgcctcatttagaaactaaaacttttgaaacaattgcaataatagcaatggaaaagcctgcacactatcctttgattgctctcaaggccttgaaaaaggctttattgctctacaaaaaggaagaaccaattgatatatcacaatacagcaaatgtatgcacaacttggttaacctctcagtgccagatggggcgtcgaatgtagagctctgtcccctggaagaagtttggggctattttgaagatgctctgagccacattagccgcactaaagactacccagaaatggagattctctggctgatggtcaagtcctggaataccggagtacttatgtttagcaggagcaagtatgcatctgctgaaaagtggtgtggcctggccttgcgtttccttaaccaccttacctccttcaaggaaagctatgaaactcagatgaatatgctgtatagtcagcttgtggaagcattgagtaacaacaagggcccagtttttcatgaacatggctactggagcaagtcagattaggcaagctcatggccacatgaagaagatacattgtcccgagatgctgactgtttaaatttttgccagagtttctcttgagcttttgtttctgtttgctcagaccctgttttcatgttgttgaataaactttctaaaataaaagcatgctgaattta

SEQ ID NO: 31337 - DNA, 3133 bp, Homo sapiens
gtgcgctgtggacggaggttgtggagagagcagggcggcattggtggctgcggctgaggcttgagccagagatttaaaaatggacaatgatgattttttttccatggactttaaagatggagtctgtctctgttgtccaggctggagtgcagtggcatgatctcggctcactgcaacctccgcctcctgtgttcaagcgattcttctgcctcagcctcccaagtagctgggactacagaagttgttgaaaacctggttacaaatgataattcacctaacataccagaggcaattgatagactcttcagcgacatagcaaatatcaacagggagtctatggctgaaataacagacattcagattgaagaaatggcagtaaacctatggaactgggcacttaccataggaggaggttggcttgtaaatgaagagcagaaaattagattacattatgttgcttgcaagttgctgagtatgtgtgaagcctcatttgcctcagaacaaagtattcaacgactgattatgatgaatatgagaataggaaaagaatggttggatgctggaaattttctaatcgctgatgaatgttttcaagctgctgtggccagtctggagcaattatacgtcaaattaattcaaaggagctcccctgaggctgacttgaccatggagaagattactgttgagagtgaccacttcagagtgctttcttaccaagcagagtcagcagttgctcaaggggattttcaaagagcatctatgtgtgtactgcaatgtaaagatatgttgatgaggctcccccagatgacttcaagtcttcatcatctctgttacaactttggagtagaaacccagaagaataataaatatgaagaaagttctttctggcttagccaaagctatgatattgggaagatggataagaaatctactgggccagaaatgctggctaaagttctacggctattagccacgaattatttggattgggatgacaccaaatattatgataaggctctcaatgctgtaaacctagcaaacaaggaacatttaagttctcctgggcttttcttaaaaatgaaaatcctcttgaaaggcgaaacatctaatgaagaactccttgaagctgtcatggaaatactacatcttgacatgcccttagacttctgtctgaacattgctaaactgctgatggatcatgaaagagaatctgttgggtttcatttcctgacgattattcatgaacgttttaagtcatcggaaaatattggaaaagttctgatactccatactgacatgcttttacaaaggaaggaagaacttcttgccaaggagaagattgaagaaatctttttagctcaccaaacaggaagacaactgacagcagaatcaatgaactggttacacaacattctgtggagacaagctgccagtagttttgaggtacaaaattacactgatgccctacaatggtactattattctctgaggttttattcaactgatgaaatggatctggacttcaccaagctgcagaggaacatggcttgctgttacctgaatttgcaacaacttgataaggccaaagaggcagtggcagaagctgaacgacatgaccctaggaacgttttcactcaattttatatattcaagattgcagtcatagagggcaactctgaaagagctttgcaggcaataattactttagagaatatattaacagatgaagagtcagaagataatgatctagttgcagagagaggttcacctaccatgcttctaagtttagctgcccagtttgctctagagaatggacaacaaattgtggcagaaaaagctttggaatatttagctcaacattcagaagaccaggaacaagttcttacagctgtaaagtgtttgcttcgttttcttcttccaaaaattgctgaaatgccggaatctgaagataagaagaaagaaatggatcgacttttgacttgcctgaatagagcctttgtgaaactttctcagccttttggtgaagaagccttaagtttggagtcaagagctaatgaagctcagtggtttcgaaaaacagcttggaacttggctgtgcaatgtgacaaagatccagtgatgatgagagagttttttatactttcttataagatgtcccagttttgtccttctgatcaagtaattctgattgcacggaaaacatgtttacttatggcagttgcagttgatctagagcaagggagaaaagcttcaacagcttttgaacagaccatgttcctgagtcgtgcacttgaggagatccagacatgcaatgacatccataatttcctgaaacaaacagggaccttctcaaatgattcatgtgagaaattgcttctgctgtacgagtttgaagttagagccaaattgaatgatccattactggaaagcttcctggaatcagtgtgggagttgcctcatttagaaactaaaacttttgaaacaattgcaataatagcaatggaaaagcctgcacactatcctttgattgctctcaaggccttgaaaaaggctttattgctctacaaaaaggaagaaccaattgatatatcacaatacagcaaatgtatgcacaacttggttaacctctcagtgccagatggggcgtcgaatgtagagctctgtcccctggaagaagtttggggctattttgaagatgctctgagccacattagccgcactaaagactacccagaaatggagattctctggctgatggtcaagtcctggaataccggagtacttatgtttagcaggagcaagtatgcatctgctgaaaagtggtgtggcctggccttgcgtttccttaaccaccttacctccttcaaggaaagctatgaaactcagatgaatatgctgtatagtcagcttgtggaagcattgagtaacaacaagggcccagtttttcatgaacatggctactggagcaagtcagattaggcaagctcatggccacatgaagaagatacattgtcccgagatgctgactgtttaaatttttgccagagtttctcttgagcttttgtttctgtttgctcagaccctgttttcatgttgttgaataaactttctaaaataaaagcatgctgaattt

SEQ ID NO: 31338 - DNA, 1147 bp, Homo sapiens
actccctcgcgttcgctgacgaggaaggtccccataccgcgaagtacattggccttggggtggggctggagggatgggcgcctgtgagaatgtgacggactgtgacacaaggaaggctggtgccttcggaatatgatggcaaatcaccttgtaaagcctgataatagaaattgcaagaggccaagagaattggagtctccagtgccagatagtccacagctgtcctctcttggaaaatcagattcatctttctctgaaatttccggactattttataaagatgaagccttggagaaagatttaaatgatgtgagcaaggaaattaatctaatgttgtctacctatgcaaagcttttaagtgagagagcagcagtagatgcatcttacattgatgagatagatgaactcttcaaagaagccaatgctattgaaaactttctaatacaaaaaagagagttcctgcgacagaggtttacagtgattgcaaacacattacacagataaaatatatacttgaaataagctgagaatttaaacctattattgttataatgaaagaatgacatttatgctttgaaagctctcgagttgttaaagaaaatgtatatctcgaatagagaaggggaaactccttgaatttctaggtttaaaaaggaacttttaaattccttaatgttaatattaatgttcatgttaatgtcctaagctggccattaacatgaactacgtcacttttcttttgagggtcaaatatttagtgcattttatagaagtgtaaattatttaaatcttatgtggattcttttattttttccttaaacttcttagtgtttctgaaacttctaaaaaaggattcagttaatttataatgtttaataatattatacttttagaatattttgtttaaatatcagatagttttggagataattttgaaattttttttatggtcaggattataaaagaagattaaaaccttagaggtgatttttccagtttcttagaatataatgacataactgtgtgctatttccatttgattattttcactattagttattatgtatgactaataaaagctctcggcttaaaattattttcttgtggtaaaagtagtaaaataaaaaccagaaattactcaccagaa

SEQ ID NO: 31339 - DNA, 787 bp, Homo sapiens
actccctcgcgttcgctgacgaggaaggtccccataccgcgaactttgtagctggtgccttcggaatatgatggcaaatcaccttgtaaagcctgataatagaaattgcaagaggccaagagaattggagtctccagtgccagatagtccacagctgtcctctcttggaaaatcagattcatctttctctgaaatttccggactattttataaagatgaagccttggagaaagatttaaatgatgtgagcaaggaaattaatctaatgttgtctacctatgcaaagcttttaagtgagagagcagcagtagatgcatcttacattgatgagatagatgaactcttcaaagaagccaatgctattgaaaactttctaatacaaaaaagagagttcctgcgacagaggtttacagtgattgcaaacacattacacagataaaatatatacttgaaataagctgagaatttaaacctattattgttataatgaaagaatgacatttatgctttgaaagctctcgagttgttaaagaaaatgtatatctcgaatagagaaggggaaactccttgaatttctaggtttaaaaaggaacttttaaattccttaatgttaatattaatgttcatgttaatgtcctaagctggccattaacatgaactacgtcacttttcttttgagggtcaaatatttagtgcattttatagaagtgtaaattatttaaatcttatgtggattcttttattttttccttaaacttcttagtgtttctgaaacttctaaaaaagg

SEQ ID NO: 31340 - DNA, 1351 bp, Homo sapiens
gggagagagatcttcctctctcttcgggcgtgttaagacagcggggttggcctgtacttcctctggccctggctgaagaggcgatcatggccttgagacctgaggaccccagtagcgggttccggcatagcaacgtggtggccttcatcaacgagaaaatggccaggcacacgaaaggccccgagttctatcttgagaatatatccttatcctgggagaaggtggaagacaagctgagggccatactggaggacagcgaggtgcccagtgaggtcaaagaggcctgcacctggggcagcctggccttgggagtgcgctttgcccacaggcaggcacagctacaaaggcacagggtgcggtggctgcacggcttcgccaaactgcacaaatcagccgcacaggccttggcatcagacctgaagaagctcagggagcagcaggagacggaacgcaaggaggcggcctcccggctaagaatggcccagaccagcctcgtggaggtgcagaaagagagagacaaggagctggtgtctccccatgagtgggagcagggggcagggtggccaggcctggccactgccggaggggtttgcacagaaggagcagctgaggaggaagaagaggcggcggtggctgctgctggtgctgctggaggaaaaggagcagaagaagagcagaggggatgttggaggttgtggctgcccctgtggaggccatggctccccctgtggaggctggggctgcccccatggagacccagttcccccacgtggaggccagggctgcctccatggagaccacagagaagctggagagaatcctcctgcagctccttggagatgctgatcaggaaaagtacacctattgggggcagaaggagggagatctccggtcggtcgaaacagccacatcttatttctctggaaccacgaacccctggtccagagcctcatcagaacctcttcctgtccagctccctgcctcatactcatactcatactcaagccctttttcctccttctcagacatacccactatatcccctccacaagcaacagtcacagcaccagttccgcctcagctgccttccgactgggaggcctttgatactagcctgtggtctgatggggggccccacagaatagaccatcaggagcacccaagagacaggagatactccgaacctcatcagcaaagacctccagtatatcgcaggccaggggactgggactgcccttggtgtaacgctgtgaatttttcacggagggatacttgcttcgactgtgggaagggaatctggctgcaaaaacctcattgagtgcagaaatgcaaaatagaaccgaagcatgta

SEQ ID NO: 31341 - DNA, 1379 bp, Homo sapiens
gggagagagatcttcctctctcttcgggcgtgttaagacagcggggttggcctgtacttcctctggccctggctgaagagggctagtgaaaccgttaaacccctaggcgatcatggccttgagacctgaggaccccagtagcgggttccggcatagcaacgtggtggccttcatcaacgagaaaatggccaggcacacgaaaggccccgagttctatcttgagaatatatccttatcctgggagaaggtggaagacaagctgagggccatactggaggacagcgaggtgcccagtgaggtcaaagaggcctgcacctggggcagcctggccttgggagtgcgctttgcccacaggcaggcacagctacaaaggcacagggtgcggtggctgcacggcttcgccaaactgcacaaatcagccgcacaggccttggcatcagacctgaagaagctcagggagcagcaggagacggaacgcaaggaggcggcctcccggctaagaatggcccagaccagcctcgtggaggtgcagaaagagagagacaaggagctggtgtctccccatgagtgggagcagggggcagggtggccaggcctggccactgccggaggggtttgcacagaaggagcagctgaggaggaagaagaggcggcggtggctgctgctggtgctgctggaggaaaaggagcagaagaagagcagaggggatgttggaggttgtggctgcccctgtggaggccatggctccccctgtggaggctggggctgcccccatggagacccagttcccccacgtggaggccagggctgcctccatggagaccacagagaagctggagagaatcctcctgcagctccttggagatgctgatcaggaaaagtacacctattgggggcagaaggagggagatctccggtcggtcgaaacagccacatcttatttctctggaaccacgaacccctggtccagagcctcatcagaacctcttcctgtccagctccctgcctcatactcatactcatactcaagccctttttcctccttctcagacatacccactatatcccctccacaagcaacagtcacagcaccagttccgcctcagctgccttccgactgggaggcctttgatactagcctgtggtctgatggggggccccacagaatagaccatcaggagcacccaagagacaggagatactccgaacctcatcagcaaagacctccagtatatcgcaggccaggggactgggactgcccttggtgtaacgctgtgaatttttcacggagggatacttgcttcgactgtgggaagggaatctggctgcaaaaacctcattgagtgcagaaatgcaaaatagaaccgaagcatgtata

SEQ ID NO: 31342 - DNA, 1374 bp, Homo sapiens
gggagagagatcttcctctctcttcgggcgtgttaagacagcggggttggcctgtacttcctctggccctggctgaagagggctagtgaaaccgttaaacccctaggcgatcatggccttgagacctgaggaccccagtagcgggttccggcatagcaacgtggtggccttcatcaacgagaaaatggccaggcacacgaaaggccccgagttctatcttgagaatatatccttatcctgggagaaggtggaagacaagctgagggccatactggaggacagcgaggtgcccagtgaggtcaaagaggcctgcacctggggcagcctggccttgggagtgcgctttgcccacaggcaggcacagctacaaaggcacagggtgcggtggctgcacggcttcgccaaactgcacaaatcagccgcacaggccttggcatcagacctgaagaagctcagggagcagcaggagacggaacgcaaggaggcggcctcccggctaagaatggcccagaccagcctcgtggaggtgcagaaagagagagacaaggagctggtgtctccccatgagtgggagcagggggcagggtggccaggcctggccactgccggaggggtttgcacagaaggagcagctgaggaggaagaagaggcggcggtggctgctgctggtgctgctggaggaaaaggagcagaagaagagcagagggatgttgaggttgtggctgcccctgtggaggccatggctccccctgtggaggctggggctgcccccatggagacccagttcccccacgtggaggccagggctgcctccatggagaccacagagaagctggagagaatcctcctgcagctccttggagatgctgatcaggaaaagtacacctattgggggcagaaggagggagatctccggtcggtcgaaacagccacatcttatttctctggaaccacgaacccctggtccagagcctcatcagaacctcttcctgtccagctccctgcctcatactcatactcatactcaagccctttttcctccttctcagacatacccactatatcccctccacaagcaacagtcacagcaccagttccgcctcagctgccttccgactgggaggcctttgatactagcctgtggtctgatggggggccccacagaatagaccatcaggagcacccaagagacaggagatactccgaacctcatcagcaaagacctccagtatatcgcaggccaggggactgggactgcccttggtgtaacgctgtgaatttttcacggagggatacttgcttcgactgtgggaagggaatctggctgcaaaaacctcattgagtgcagaaatgcaaaatagaaccgaagcatgt

SEQ ID NO: 31343 - DNA, 1248 bp, Homo sapiens
tctcttcaggcgtgttaagcagcggggttggcctgtacttcctctggccctggctgaagagggctagtgaaaccgttaagcccctaggcgatcatggccttgagacctgaggaccccagtagtgggttccggcacggaaacgtggtggccttcatcatcgagaaaatggccaggcacacgaaaggccccgagttctacttcgagaatatatccttatcctgggaggaggtggaagacaagctcagggccatcctggaggacagcgaggtgcccagcgaggtcaaagaggcctgcacctggggcagcctggccttgggtgtgcgctttgcccacaggcaggggcagttacaaaaccgcagggtgcagtggctgcaaggctttgccaaactgcacagatcagctgcgctggtcttggcctcaaacctgacggaactcaaggaacagcaggagatggaatgcaatgaggcgaccttccagttgcagctaaccgagaccagccttgcggaggtgcagagagagcgggacatgctgagatggaagctcttccatgccgagctggcacctccccagggacagggccaggctacagtgtttccaggcctggccactgccggaggggattggacagaaggagcaggtgagcaggaaaaggaggcggtggctgctgctggtgctgctggaggaaaaggagaggagaggtatgcagaggcagggcctgcccccgcagaggtcttgcaggggctgggaggaggcttcaggcagcccctcggagctattgtagcaggcaaattacacctttgcggggcagagggagaaagatctcaggtcagtacaaacagccatgtctgtcttctctgggcttgggtccacagtctcactggagcctcttcctgtccagctccctacctcattcacatactcatacccatgccctttgtccgccttctcagccatacccaatatacccccttcaccagcaaaggtcacagaacgggttccaactcagatgcctttcaactggggggcctctgatgctagcctgtggtcagatgtggaggcccagggaatagaccctcaagagcccccaagagacaggagagactccgaactccatcagcagagaagacctccagtatatcgcaggccagggaactgggactgcccgtggtgtaaagctgtgaatttttcatggagggaaaattgcttcctctgtgggaggcgaatctggctgcaaaagcctcagtaaat

SEQ ID NO: 31344 - DNA, 4942 bp, Homo sapiens
atcagtccgcattccccgcacccacccacgtcttcccgggagtcgtatcccgagcatggaggttactgagaccgttatttcttcatggcctgcctagcttaagcagtagctggaaaagatgtctcgggctgttcgtcttccagtcccctgtcctgttcaacttggtaccttaagaaatgactccctggaagctcagcttcatgagtatgtcaaacaagggaactatgtgaaagtgaagaaaattcttaagaaaggaatttatgttgatgcagttaactccttgggccaaacagcactttttgttgcggcgttattgggccttaggaaattcgttgatgttctggtggattatggatcagatccaaatcaccgctgctttgatgggagcacccctgtccatgcagcagcattttcgggcaatcagtggatccttagcaaactgctggatgcaggaggtgacctgcgactccacgatgagaggggtcaaaacccgaagacttgggctttgacagcaggaaaggagcgtagcacccagatagtggagttcatgcagcgctgtgcctcacacatgcaggccatcatccagggcttctcttacgacctcctgaagaagatagactccccgcagcggcttgtctacagcccgtcctggtgtgggggcctcgtgcagggaaaccctaatggctctcctaaccgactgcttaaagctggagtcatttctgctcaaaatatctacagctttggttttgggaaggctatgccttggtttcagttttatcttactggggcgacacagatggcctatctaggatctcttccggtcattggagaaaaggaagtgattcaagctgatgatgagcccaccttctctttcttcagcggcccctacatggtcatgaccaacctagtgtggaatgggagcagggtcacagtgaaagagctgaatctccccacccacccacactgcagcaggctgcggctggccgacttgttaattgccgagcaggaacacagcagcaagctgcggcacccctacttgctacagttgatggctgtgtgtctctcccaggacctagagaaaacccgccttgtgtacgagcgcatcactatcggcacattgttcagtgtccttcatgaacgacggtcccagttcccagtgctgcacatggaggtgattgtgcacctgctgctccagatatctgatgccctgagatacctgcatttccaggggtttatccaccgctccctcagctcctatgctgtccatatcatctccccaggtgaagcgaggctgaccaacctggagtacatgttggaaagcgaggacagaggtgtacagagggacctgactcgagtgccccttcctacgcagctatacaactgggccgcaccagaagtgatcttacagaaggcagccacagtgaaatcagacatctacagcttttctatgatcatgcaggagattttaacagatgacataccctggaagggcttagatggctcagttgttaaaaaagccgtagtctcggggaattatttagaagctgatgtcaggcttccgaaaccttactatgatattgttaagtcaggcatccacgtcaagcagaaagaccgaactatgaaccttcaagatatccggtatattctgaagaatgacttaaaggattttactggagcccagagaactcaaccaaccgagagccccagagtgcagagatacggactccatcccgatgtcaatgtctatctaggactgacttcagaacaccccagagagacacctgacatggaaatcatagaactaaaggaaatgggcagtcaacctcattcaccaagggttcactctttattcactgaggggacactagatcctcaggccccagatccatgtctgatggccagggagactcagaatcaagatgctccttgccctgctccatttatggcagaagaggccagcagccccagcacaggtcagccaagcctctgcagtttcgaaatcaacgagatctactcaggctgcttgattttggaagatgacatagaagagcctccaggagctgcttcatctttggaggcagacggacctaaccaggtagatgaactgaaatccatggaagaagagctggataagatggagagagaggcgtgttgttttggcagtgaggatgagagctcttcaaaagctgagacagagtactcttttgatgactgggactggcaaaacggttcactcagttcactcagccttcctgagtcaaccagagaagccaagagcaatttgaacaacatgtccacgactgaggagtatctcatcagtaagtgtgtgctggatctaaagattatgcagacaataatgcacgagaatgatgataggctgaggaatatcgagcagatattagatgaagtcgagatgaaacagaaggaacaggaagagcgcatgtctttatgggccacttcaagagagtttacaaatgcctacaagttacctctggccgtgggccctccatctttaaactatattcctcctgtcctacagctttcagggggtcagaagccagacaccagtggcaactacccaaccctaccaagatttccaagaatgctgccgactctttgtgaccctggaaaacagaacacagatgaacaatttcagtgcactcaaggagccaaggacagtttggaaacaagcaggatccaaaataccagtagccagggaagacctagagagtccactgcccaagccaaagccacacagtttaatagtgcactcttcactctgtcaagccaccggcagggaccttctgcatcacccagctgtcactgggactctaccaggatgagtgtggaacctgtttcttctgaaatctataatgcagagtccagaaataaagatgatggaaaggtacacttaaaatggaaaatggaggtgaaagaaatggcaaagaaagcagctactggacagctcacagtacctccttggcatcctcagagtagtctgactttagagagcgaggctgaaaatgagcccgacgccctgctgcagccccccattaggagcccagaaaacacggattggcagcgagttattgagtatcatagggaaaatgatgagcccagaggaaatggcaagtttgacaagacgggcaacaatgactgtgacagtgaccagcatggcagacagcccaggcttggaagcttcaccagtatcaggcacccatctcccagacaaaaggagcaaccagagcatagtgaagccttccaagcaagttctgacacattggtggctgtagagaaatcttacagtcatcagtccatgcaatcaacttgttcaccagagtcttctgaggatataacagatgaatttttaactccagacggtgaatatttttactcctcgactgctcaagaaaacttagctctagagacctcgagtcccatagaagaggactttgaaggaatacaaggtgcatttgcccaacctcaagtctctggtgaggaaaagttccaaatgagaaaaattcttggaaagaatgctgagattttgcccaggtctcaatttcaacctgtacgaagtactgaagatgaacaagaagagacatcaaaggagtcaccaaaggaactgaaagagaaagacatatcattgacggatattcaagacctgtctagtatctcctatgaaccagacagctcttttaaggaagcttcatgcaaaacacccaaaataaaccatgcacctaccagtgtcagcactccactcagcccagggtccgtttcttcagctgccagtcagtataaagactgccttgaaagtatcacatttcaggttaagacagagtttgcctcttgctggaacagtcaagaatttattcaaactttgtctgatgactttataagtgtccgagagagagcaaagaaactggattctctccttacttcctctgaaactcccccttcaagactgactggtcttaaaagattgtcttcatttattggggctggatcccccagccttgttaaggcatgtgactcatcaccaccccatgccacccagagaaggagcctgcctaaagtagaagccttctcacagcatcacattgatgagctgccaccaccatctcaggagctacttgatgacattgagctcttgaaacagcagcagggctcatccacggtgttgcatgagaacacagcaagtgatggaggaggcactgcaaatgatcaaaggcacttagaagaacaagaaactgacagtaaaaaagaagatagtagtatgcttttgtccaaagaaactgaagatcttggagaggacacagagagagctcactctactctggatgaggacctggaaagatggctgcagccacctgaggagagcgtggagctacaagaccttcccaagggctctgaaagggagacaaatatcaaagatcaaaaagttggtgaagagaaaagaaaaagggaagatagcattacaccagaaagaaggaaatcagagggtgttctagggacttctgaagaagatgaactaaaatcctgtttttggaagcgactaggttggtccgaatcatccaggataatcgtgctggatcagagtgacttgtcagactgattggaattggatcatagacggactcctggcctgagtttgagtgtcctggttgtaagctcctttcttctctttctgcttcagttgctgtcagggcagcagttccagttctgtaagtctcactttgttcagctgccacaatagacatcatcgtttggccctctctgttagcagcacattcaaccatttgttttcagtcagatttctgaaaagtgagaggtagttttgatagtaaaaatttttggttgtgcctagaatggctttggttttgttgatgttaattttcaaaaactttaactcttgttatataataaaatgtttaattttaataac

SEQ ID NO: 31345 - DNA, 4804 bp, Homo sapiens
atcagtccgcattccccgcacccacccacgtcttcccgggagtcgtatcccgagcatggaggttactgagaccgttatttcttcatggcctgcctagcttaagcagtagctggaaaagatgtctcgggctgttcgtcttccagtcccctgtcctgttcaacttggtaccttaagaaatgactccctggaagctcagcttcatgagtatgtcaaacaagggaactatgtgaaagtgaagaaaattcttaagaaaggaatttatgttgatgcagttaactccttgggccaaacagcactttttgttgcggcgttattgggccttaggaaattcgttgatgttctggtggattatggatcagatccaaatcaccgctgctttgatgggagcacccctgtccatgcagcagcattttcgggcaatcagtggatccttagcaaactgctggatgcaggaggtgacctgcgactccacgatgagaggggtcaaaacccgaagacttgggctttgacagcaggaaaggagcgtagcacccagatagtggagttcatgcagcgctgtgcctcacacatgcaggccatcatccagggcttctcttacgacctcctgaagaagatagactccccgcagcggcttgtctacagcccgtcctggtgtgggggcctcgtgcagggaaaccctaatggctctcctaaccgactgcttaaagctggagtcatttctgctcaaaatatctacagctttggttttgggaagttttatcttactggggcgacacagatggcctatctaggatctcttccggtcattggagaaaaggaagtgattcaagctgatgatgagcccaccttctctttcttcagcggcccctacatggtcatgaccaacctagtgtggaatgggagcagggtcacagtgaaagagctgaatctccccacccacccacactgcagcaggctgcggctggccgacttgttaattgccgagcaggaacacagcagcaagctgcggcacccctacttgctacagttgatggctgtgtgtctctcccaggacctagagaaaacccgccttgtgtacgagcgcatcactatcggcacattgttcagtgtccttcatgaacgacggtcccagttcccagtgctgcacatggaggtgattgtgcacctgctgctccagatatctgatgccctgagatacctgcatttccaggggtttatccaccgctccctcagctcctatgctgtccatatcatctccccaggtgaagcgaggctgaccaacctggagtacatgttggaaagcgaggacagaggtgtacagagggacctgactcgagtgccccttcctacgcagctatacaactgggccgcaccagaagtgatcttacagaaggcagccacagtgaaatcagacatctacagcttttctatgatcatgcaggagattttaacagatgacataccctggaagggcttagatggctcagttgttaaaaaagccgtagtctcggggaattatttagaagctgatgtcaggcttccgaaaccttactatgatattgttaagtcaggcatccacgtcaagcagaaagaccgaactatgaaccttcaagatatccggtatattctgaagaatgacttaaaggattttactggagcccagagaactcaaccaaccgagagccccagagtgcagagatacggactccatcccgatgtcaatgtctatctaggactgacttcagaacaccccagagagacacctgacatggaaatcatagaactaaaggaaatgggcagtcaacctcattcaccaagggttcactctttattcactgaggggacactagatcctcaggccccagatccatgtctgatggccagggagactcagaatcaagatgctccttgccctgctccatttatggcagaagaggccagcagccccagcacaggtcagccaagcctctgcagtttcgaaatcaacgagatctactcaggctgcttgattttggaagatgacatagaagagcctccaggagctgcttcatctttggaggcagacggacctaaccaggtagatgaactgaaatccatggaagaagagctggataagatggagagagaggcgtgttgttttggcagtgaggatgagagctcttcaaaagctgagacagagtactcttttgatgactgggactggcaaaacggttcactcagttcactcagccttcctgagtcaaccagagaagccaagagcaatttgaacaacatgtccacgactgaggagtatctcatcagtaagtgtgtgctggatctaaagattatgcagacaataatgcacgagaatgatgataggctgaggaatatcgagcagatattagatgaagtcgagatgaaacagaaggaacaggaagagcgcatgtctttatgggccacttcaagagagtttacaaatgcctacaagttacctctggccgtgggccctccatctttaaactatattcctcctgtcctacagctttcagggggtcagaagccagacaccagtggcaactacccaaccctaccaagatttccaagaatgctgccgactctttgtgaccctggaaaacagaacacagatgaacaatttcagtgcactcaaggagccaaggacagtttggaaacaagcaggatccaaaataccagtagccagggaagacctagagagtccactgcccaagccaaagccacacagtttaatagtgcactcttcactctgtcaagccaccggcagggaccttctgcatcacccagctgtcactgggactctaccaggatgagtgtggaacctgtttcttctgaaatctataatgcagagtccagaaataaagatgatggaaaggtacacttaaaatggaaaatggaggtgaaagaaatggcaaagaaagcagctactggacagctcacagtacctccttggcatcctcagagtagtctgactttagagagcgaggctgaaaatgagcccgacgccctgctgcagccccccattaggagcccagaaaacacggattggcagcgagttattgagtatcatagggaaaatgatgagcccagaggaaatggcaagtttgacaagacgggcaacaatgactgtgacagtgaccagcatggcagacagcccaggcttggaagcttcaccagtatcaggcacccatctcccagacaaaaggagcaaccagagcatagtgaagccttccaagcaagttctgacacattggtggctgtagagaaatcttacagtacctcgagtcccatagaagaggactttgaaggaatacaaggtgcatttgcccaacctcaagtctctggtgaggaaaagttccaaatgagaaaaattcttggaaagaatgctgagattttgcccaggtctcaatttcaacctgtacgaagtactgaagatgaacaagaagagacatcaaaggagtcaccaaaggaactgaaagagaaagacatatcattgacggatattcaagacctgtctagtatctcctatgaaccagacagctcttttaaggaagcttcatgcaaaacacccaaaataaaccatgcacctaccagtgtcagcactccactcagcccagggtccgtttcttcagctgccagtcagtataaagactgccttgaaagtatcacatttcaggttaagacagagtttgcctcttgctggaacagtcaagaatttattcaaactttgtctgatgactttataagtgtccgagagagagcaaagaaactggattctctccttacttcctctgaaactcccccttcaagactgactggtcttaaaagattgtcttcatttattggggctggatcccccagccttgttaaggcatgtgactcatcaccaccccatgccacccagagaaggagcctgcctaaagtagaagccttctcacagcatcacattgatgagctgccaccaccatctcaggagctacttgatgacattgagctcttgaaacagcagcagggctcatccacggtgttgcatgagaacacagcaagtgatggaggaggcactgcaaatgatcaaaggcacttagaagaacaagaaactgacagtaaaaaagaagatagtagtatgcttttgtccaaagaaactgaagatcttggagaggacacagagagagctcactctactctggatgaggacctggaaagatggctgcagccacctgaggagagcgtggagctacaagaccttcccaagggctctgaaagggagacaaatatcaaagatcaaaaagttggtgaagagaaaagaaaaagggaagatagcattacaccagaaagaaggaaatcagagggtgttctagggacttctgaagaagatgaactaaaatcctgtttttggaagcgactaggttggtccgaatcatccaggataatcgtgctggatcagagtgacttgtcagactgattggaattggatcatagacggactcctggcctgagtttgagtgtcctggttgtaagctcctttcttctctttctgcttcagttgctgtcagggcagcagttccagttctgtaagtctcactttgttcagctgccacaatagacatcatcgtttggccctctctgttagcagcacattcaaccatttgttttcagtcagatttctgaaaagtgagaggtagttttgatagtaaaaatttttggttgtgcctagaatggctttggttttgttgatgttaattttcaaaaactttaactcttgttatataataaaatgtttaattttaataac

SEQ ID NO: 31346 - DNA, 4924 bp, Homo sapiens
atcagtccgcattccccgcacccacccacgtcttcccgggagtcgtatcccgagcatggaggttactgagaccgttatttcttcatggcctgcctagcttaagcagtagctggaaaagatgtctcgggctgttcgtcttccagtcccctgtcctgttcaacttggtaccttaagaaatgactccctggaagctcagcttcatgagtatgtcaaacaagggaactatgtgaaagtgaagaaaattcttaagaaaggaatttatgttgatgcagttaactccttgggccaaacagcactttttgttgcggcgttattgggccttaggaaattcgttgatgttctggtggattatggatcagatccaaatcaccgctgctttgatgggagcacccctgtccatgcagcagcattttcgggcaatcagtggatccttagcaaactgctggatgcaggaggtgacctgcgactccacgatgagaggggtcaaaacccgaagacttgggctttgacagcaggaaaggagcgtagcacccagatagtggagttcatgcagcgctgtgcctcacacatgcaggccatcatccagggcttctcttacgacctcctgaagaagatagactccccgcagcggcttgtctacagcccgtcctggtgtgggggcctcgtgcagggaaaccctaatggctctcctaaccgactgcttaaagctggagtcatttctgctcaaaatatctacagctttggttttgggaagttttatcttactggggcgacacagatggcctatctaggatctcttccggtcattggagaaaaggaagtgattcaagctgatgatgagcccaccttctctttcttcagcggcccctacatggtcatgaccaacctagtgtggaatgggagcagggtcacagtgaaagagctgaatctccccacccacccacactgcagcaggctgcggctggccgacttgttaattgccgagcaggaacacagcagcaagctgcggcacccctacttgctacagttgatggctgtgtgtctctcccaggacctagagaaaacccgccttgtgtacgagcgcatcactatcggcacattgttcagtgtccttcatgaacgacggtcccagttcccagtgctgcacatggaggtgattgtgcacctgctgctccagatatctgatgccctgagatacctgcatttccaggggtttatccaccgctccctcagctcctatgctgtccatatcatctccccaggtgaagcgaggctgaccaacctggagtacatgttggaaagcgaggacagaggtgtacagagggacctgactcgagtgccccttcctacgcagctatacaactgggccgcaccagaagtgatcttacagaaggcagccacagtgaaatcagacatctacagcttttctatgatcatgcaggagattttaacagatgacataccctggaagggcttagatggctcagttgttaaaaaagccgtagtctcggggaattatttagaagctgatgtcaggcttccgaaaccttactatgatattgttaagtcaggcatccacgtcaagcagaaagaccgaactatgaaccttcaagatatccggtatattctgaagaatgacttaaaggattttactggagcccagagaactcaaccaaccgagagccccagagtgcagagatacggactccatcccgatgtcaatgtctatctaggactgacttcagaacaccccagagagacacctgacatggaaatcatagaactaaaggaaatgggcagtcaacctcattcaccaagggttcactctttattcactgaggggacactagatcctcaggccccagatccatgtctgatggccagggagactcagaatcaagatgctccttgccctgctccatttatggcagaagaggccagcagccccagcacaggtcagccaagcctctgcagtttcgaaatcaacgagatctactcaggctgcttgattttggaagatgacatagaagagcctccaggagctgcttcatctttggaggcagacggacctaaccaggtagatgaactgaaatccatggaagaagagctggataagatggagagagaggcgtgttgttttggcagtgaggatgagagctcttcaaaagctgagacagagtactcttttgatgactgggactggcaaaacggttcactcagttcactcagccttcctgagtcaaccagagaagccaagagcaatttgaacaacatgtccacgactgaggagtatctcatcagtaagtgtgtgctggatctaaagattatgcagacaataatgcacgagaatgatgataggctgaggaatatcgagcagatattagatgaagtcgagatgaaacagaaggaacaggaagagcgcatgtctttatgggccacttcaagagagtttacaaatgcctacaagttacctctggccgtgggccctccatctttaaactatattcctcctgtcctacagctttcagggggtcagaagccagacaccagtggcaactacccaaccctaccaagatttccaagaatgctgccgactctttgtgaccctggaaaacagaacacagatgaacaatttcagtgcactcaaggagccaaggacagtttggaaacaagcaggatccaaaataccagtagccagggaagacctagagagtccactgcccaagccaaagccacacagtttaatagtgcactcttcactctgtcaagccaccggcagggaccttctgcatcacccagctgtcactgggactctaccaggatgagtgtggaacctgtttcttctgaaatctataatgcagagtccagaaataaagatgatggaaaggtacacttaaaatggaaaatggaggtgaaagaaatggcaaagaaagcagctactggacagctcacagtacctccttggcatcctcagagtagtctgactttagagagcgaggctgaaaatgagcccgacgccctgctgcagccccccattaggagcccagaaaacacggattggcagcgagttattgagtatcatagggaaaatgatgagcccagaggaaatggcaagtttgacaagacgggcaacaatgactgtgacagtgaccagcatggcagacagcccaggcttggaagcttcaccagtatcaggcacccatctcccagacaaaaggagcaaccagagcatagtgaagccttccaagcaagttctgacacattggtggctgtagagaaatcttacagtcatcagtccatgcaatcaacttgttcaccagagtcttctgaggatataacagatgaatttttaactccagacggtgaatatttttactcctcgactgctcaagaaaacttagctctagagacctcgagtcccatagaagaggactttgaaggaatacaaggtgcatttgcccaacctcaagtctctggtgaggaaaagttccaaatgagaaaaattcttggaaagaatgctgagattttgcccaggtctcaatttcaacctgtacgaagtactgaagatgaacaagaagagacatcaaaggagtcaccaaaggaactgaaagagaaagacatatcattgacggatattcaagacctgtctagtatctcctatgaaccagacagctcttttaaggaagcttcatgcaaaacacccaaaataaaccatgcacctaccagtgtcagcactccactcagcccagggtccgtttcttcagctgccagtcagtataaagactgccttgaaagtatcacatttcaggttaagacagagtttgcctcttgctggaacagtcaagaatttattcaaactttgtctgatgactttataagtgtccgagagagagcaaagaaactggattctctccttacttcctctgaaactcccccttcaagactgactggtcttaaaagattgtcttcatttattggggctggatcccccagccttgttaaggcatgtgactcatcaccaccccatgccacccagagaaggagcctgcctaaagtagaagccttctcacagcatcacattgatgagctgccaccaccatctcaggagctacttgatgacattgagctcttgaaacagcagcagggctcatccacggtgttgcatgagaacacagcaagtgatggaggaggcactgcaaatgatcaaaggcacttagaagaacaagaaactgacagtaaaaaagaagatagtagtatgcttttgtccaaagaaactgaagatcttggagaggacacagagagagctcactctactctggatgaggacctggaaagatggctgcagccacctgaggagagcgtggagctacaagaccttcccaagggctctgaaagggagacaaatatcaaagatcaaaaagttggtgaagagaaaagaaaaagggaagatagcattacaccagaaagaaggaaatcagagggtgttctagggacttctgaagaagatgaactaaaatcctgtttttggaagcgactaggttggtccgaatcatccaggataatcgtgctggatcagagtgacttgtcagactgattggaattggatcatagacggactcctggcctgagtttgagtgtcctggttgtaagctcctttcttctctttctgcttcagttgctgtcagggcagcagttccagttctgtaagtctcactttgttcagctgccacaatagacatcatcgtttggccctctctgttagcagcacattcaaccatttgttttcagtcagatttctgaaaagtgagaggtagttttgatagtaaaaatttttggttgtgcctagaatggctttggttttgttgatgttaattttcaaaaactttaactcttgttatataataaaatgtttaattttaataac

SEQ ID NO: 31347 - DNA, 10187 bp, Homo sapiens
ggacagacagagcacagtttagcagaaattagagacacttctcaagtacttgcacatgattcagacatttcacttatgcccagtgatgccaaagacagtgttaatggtgaccttttgttaaattggacaagtcttaaaaatattttaagtggtcttaatgcttcttttcctcttcacaacaatactggctcaagcacagtcactacttcaaaatccatcaaagacccaagactgatgaggagagaagaaagtatgggagaacagagtagtactgcaggcttaaatgaggttttgcaatttgagaagagttcagataatgttaattcagaaataaaatcgacaccatctaattctgcctcctcctcagaagttgtccctggtgattgtgctgttcttactaatggtttggataccccttgctttaaaacttctgttaatgattcacaatcttgggctcacaacatgggctctgaggactatgactgtatacctcccaataaagttaccatggcagggcaatgtaaggaccaaggtaatttttccttcccaatttctgtgtcaaatgtagtgtcagaggttgagaaccaaaaccacagtgaggagaaggctcagagagcccaacaggagtccggtaatgcttatacaaaagagtacagtagtcacatttttcaggactcgcagtcttctgatttaaaaacaatttatcagactggttgccaaacgtctacagtttttccactcaaaaagaaagtaagcattgatgaataccttcaaaatactggaaagatgaaaaacttcgctgacctggaagacagttccaaacatgaagaaaagcaaacttcatggaaagaaattgataatgatttcactaatgaaacaaaaatcagtccaatagataattacattgttttgcaccaagaatacaaagagagtgagagtcataattcttttgggaaaagctgtgataaaatattaattactcaagagttagaaataacaaaatcttctacatctaccataaaggataaggatgaactagatcatctagcattggaatggcaaattactccaagttttgagagcctgtcacaaaagcatcctcagcactctgtggagtatgagggtaacattcatacaagtttagccattgctcaaaagctaatggaactgaaattggggaaaataaatcaaaattatgctagcattataactgaagctttcccgaaaccaaaagacataccccaggccaaagaaatgttcattgatacagttatttcatcttataacatagaaacagctcatgacagttcaaattgcagcataactagagaacatatatgtgtccataggaaaaatgaaaatgaaccagtgtcattagagaacattcagagagactataaagaaactgcttatgttgaagataggggtcaggatcacaatctgttctgtaattcacagttaagcaatgatatatggctgaatgttaatttcaaaaaacaaacagatagagaaaaccaaaatgaggctaaagagaatagtgcttcatgtgtagaaaacaacatagagaacatatatggagacaaaaagcaggattctcatacaaacgaaaatttcagcaatatagatgaaaaggaggacaaaaattaccacaatatagaaattttgagttctgaagaattttctactaaatttaacttgatttgcagagaagataatgcagtgtcagcagcaactgcattattagagagtgaagaagataccattagtgccgtgaaacaaaaagatactgaaaatactggaagaagtgtagagcatttggcttccacgacatttcccaaaactgcaagttcttcagtgtgtgtagcctcaaatgctgcaatacagatagctagtgctactatgcctgcattaagcctaaataatgacgatcaccagatataccagtttaaagaaacttgttcttctgaaagtccagattttggtttgttagtaaaacatagggtttctgattgtgaaattgatacggataaaaataaatcacaagaatcatttcatcaatcaataaatgagaacttagttcttcagagcattgaattggaaagtgaaattgaaatagaattagaagattgtgatgatgcttttatatttcaacaagatacacatagccatgaaaacatgctttgtgaagaatttgtgacctcatataaggctctgaagtctcgtatcagttgggaaggtctgttagcacttgataacggggagatggaagttttggaaagcaccacaggaagggagaatagtgatcagcattattctaaggaaagtaactatttttattcctctacacaaaacaatgaaacagaacttaccagcccaattttacttccagatctacaaattaaaattactaatatatttaggccaggattcagcccgacagctgactcccttgcattgaaagatagtttttgcacacatgtaactgaagccacaaaaccggaaataaataaggaagatggagaaattctaggatttgacatttattcccagccttttggtgaaaatgcagattatccatgtgaagataaagttgataatataaggcaagaatcagggccagtgagtaactctgaaatctccctttcttttgacttgagtcgtaatacagatgtgaatcatacgtctgaaaatcagaacagtgaatctttgtttactgaaccttctaatgtcacaacaatagatgatggaagcagatgtttctttacaaaatcaaaaactgactataatgataccaaaaataaaaaggaggtagaatcaagaattagcaaaaggaagctacatatatcttccagggatcagaacataccacataaagatttaagacgacataaaatttatgggagaaagaggaggctaaccagtcaagactcatctgagtgtttctcttcattatcccaaggacgaattaaaacattttcacagtcagaaaagcacattaagagtgtcctaaatatcctaagtgatgaagcatctttatgtaaaagcaaatgtctttccagaaaactagacaaagcagttgttcacttaaaaaaagctcatagaagagttcacacatctttgcagcttataactaaagtaggagaagaaagaaagggcccattaccaaaatcatatgcaataatatgcaataatttctgggaaagttgtgaccttcaaggttatagttctgtgtctcaaagaaaatattattctactaagcatttttcgtcaaaaagaaaatatgacaaacggagaaagaaaagagctccaaaagctgatatttctaaatcattaacccatgtgtcaaagcacaagtcttataaaacaagtggagagaaaaaatgcctttctaggaaaagtatggctagcagtgtctcaaaaagtcaccccaccaccagtcacatgggagaattttgtaatcaagaacatcctgaatcacagttgcctgtatcctccacatcccaaagtacaagtcagtcagtttattataatagcagtgtaagcaatccaagtttatcagaagaacatcagcccttttctggaaaaactgcatatctgttttccccagaccactcagatgagaaactaatagaaaaagaaaatcaaattgatacagcatttttatctagcactagtaaatatgaaaagcttgaaaaacattcagcaaatcataatgttaaagatgcaactaaagaaaacagttgtgacgctaatgaagtaataaatgaaagtaattctgtatctttaagttgcataaaagaaaacataaattctagtacaggcaacgattgtgatgcaacttgcataggtcacacaaaggcgaaaactgacgtacttatatcagtcttagattcaaatgtgaagcactttttaaatgatctctaccaacaaggtaaccttattttatctgattgtaaaagaaacctggaagtaaagtggacagatcctattgagagacccaaacaaaacattattacaggaaacttccttatgggcccattaaacctaactttgatagcaagtaaaaagtacagtattcctcagttatcagccgctgcagtgacagatagtgagggagaatcttcaaaatcttacttggataagcagagaattcttactgtagattcttttgcagcatccagtactgtaccacactgtgagcagagctgtagagaaaaagagcttctaaagacagaacagtgctcttcaggtaattgcctccatacagatgggaatgaaacaaatgtcactgagaattatgagttggatgtagcatcaggaactgaagaagataaaagttatggggaaaatatagtggaattatcttccagtgatagttctctgcttttaaaagataatgtaaaaggctcctcttcagaaacatgtattgtgaagaaagacactgaggacagaataacgtggaaagttaaacaagcggaaaaagcaaaagattctgtttacaaaagaagcatgactgaaggatcaactgttaatactgagtacaaaaatcaaaagaatcagatctcagaagaatcctgcttaaatgagaaaattattacaactaacttgattgattcccatctgagcactaaaaatactaccactgagtcagtccctttgaagaacacagtttctaatccgcttaacaaaagagagaagaagggggaaattaaagttagtaaagactcgcagtctgacttgacattacattcagaaatagcctatatttccaaaccaggaattctaggagttaatcatacgcctattttacctgcccactctgaaacctgtaaagtccctactcttctgaagaaacctgcgtcatacgtgagtgattttaaagaaaaacattgctcagctaatcatacggcccttatagctaatctatctcaaattttgcagagggcagatgaagcatcatctttgcagattctacaggaagaaactaaggtttgtctaaatattctccctttatttgtggaagcttttgaaagaaagcaagaatgttcagttgaacaaatcctgatttcaagagaactgttggtagaccaaaacctgtggaataattgcaaacacacattaaaaccatgtgctgttgacactttggtagaacttcaaatgatgatggaaacaattcaattcattgaaaacaaaaaaaggcacttagaaggtgaaccaacattgcgaagcttgctttggtatgatgaaacactgtatgctgagcttcttggaaaaccacgtggatttcaacagcagtctaatttctatcctggtttccaaggaagattaaaatataatgcattctgtgagttacagacttaccatgatcaattagttgaattgcttgaagaaacaaaaagggaaaagaattcatactatgtattcttaaagtacaaacgacaggttaatgaatgtgaagccataatggagcattgttccgattgctttgatttttctctttctgttccatttacctgtggagttaactttggagatagtttagaagacctggaaatcttaagaaaaagtactttaaagttgatcaatgtatgtggggactctcctaaagttcattcgtatccaggaaaacaggaccatctgtggattatcatagaaatgatctcctcaaaggttaattttattaagaacaacgaggcagtacgtgttaaaatatctctttatggtctggaacatatcttttttgatgctgcaaaaaatcttgtttggaaagagagaacacaatccttcagcaaaaaatactcacaaaagaaggacgaagaaaggctactcagagtgaataaatgtgccttttctaagttgcagaagatatatgatactttgtctaaagatttaaacaatgaaccaatttcccctattgggcttgaggaggatactataattgcttccagaaagtcagatcatccaataaacgaagcaacaattagcatagaaaattctaaatttaacagtaatttgcttgcacacccagatatttgttgtattagtgagatattggatcaggctgaatttgcagaccttaaaaaattacaggatctcaccttgagatgtacagatcacttagaaattttaaaaaaatactttcagatgctacaagataataacatggataatatttttatcacagaagaaaatgttttagacgtggtgataaaccacagccatgaggctatcattttaaagcctgaagctattgaaatgtatattgaaatcgtcatggtctcagaaacaattcactttcttaaaaactcaatagcaaagaaactagacaaacagaggtttcgaggtatgctttggtttgatttgtcacttcttcctgagctggttcagtgccaagaaaaaatggcttctttttcatttcttaaagataactcaacagatgtttgcctttggaaagtgatagagactgctgtttccgaacttaagaaagatctggatattatctgcaaatataatgaagctgttaattgctcatatgctattcatttgctctcaagagaacttcaagaactttcagaaataaaaaagcttctgaagaagtccaagtattttatttccacatatattgactttgtgccatatatagcatccataaattatggaagcactgtgacagagttagaatacaactacaatcaattttctacactgctgaagaatgtaatgtctgcccctaggaaagatttaggaaaaatggcccacattaggaaagtcatgaaaacgattgaacatatgaagatgatatgtactaaaaatgctgaactaaccatttcctttttcctatgccaaatgctgtataacagaaggaagattttacagctgaagagaaaagaaaaaatgaatattcatattgtaaaacctggggaaaataacaataaatttagtatttctacgatgttgcccccagtatcagagtgcataaacaaaaacatctcaaattcctctaaaaaacgaccgagcactgtagacaaatgtgaagactctcaggaacaacagcaagatactactgtttccagttgtaaaaagctaaaggtagacatgaaagatgtcacaaaaatcaacagagaaaaggcaacattcaagcatccaaggactacaggatctcatcccaaaagcgaaaacaaaatagtaccaagttcatgtgacagtctgaaaagaaatcatttaacgccaaaaaaggttgaaatgcaaagatcactacctggctcacttttacccttagagaacccaaaagacacttgcgcatcaaagtcggaaagcaaaatagacttaactgtttcatctgatcacttcagtggacaacaggaaaatttaaatagcatgaagaaaagaaatgtgaacttcagtgctgctgaaacaaaaagtgataagaaagattgtgctgcttttgcaatttgtgaccaaaaaagtgtacatggcacattttcaccagaccatgggacgcttttgcagaaatttcttaaaaattccccagatcccacccaaaaatcctgcctttctgatataaacccagaaactgatgtttctcttgtgcctgatgcgtcggtgctctcaaagccaattttctgttttgtgaaagatgtccatcctgatctagaaatgaatgacacagtctttgaacttcaagataatgatatagtaaattcatctattaaaaattcctcatgcatgacttctccagaacccatctgtatccagaacaaaattcctactctgcagataaacaaactacagcctacagaaactgagtcagaggacaaatacatgaaggatacattgaatcccaatactgtgcatacttttggagcatctgggcatataacccttaatgtgaatcaaggagcagagtactctctttctgaacaacagaatgacaaaaattcaaaagtcctaatgcagaatgctgccacatattggaatgaacttccacagtctgcatgtaacccaacatataattcttctgagcatttatttggaacttcatatccatactctgcttggtgtgtttatcagtacagcaacagcaatggcaatgccattacccagacataccaagggataacatcatatgaagtacagccatctccttctgggctgttgaccacagttgcaagtactgcccagggcacacattctaatcttctgtactctcaatattttacttattttgcgggggagccacaagcaaatggctttgtgccagtgaatgggtattttcaatctcaaatacctgcttctaattttcggcagccaattttttcacaatatgcttctcatcagccattaccacaagctacatacccttaccttcctaatcgatttgtgcctccagaagttccttgggtttatgctccatggcaccaagaatcctttcatccaggacactgaaaatagtcttctgtctattgaaataagacataacaagtttttccaaatattttttacttatatattttttaacatttagcgatttttaatgtttgtaaatgtggtaggaaatataaatcatatggtcctttgtaaaatatacaaataatctaacacatatcatataggacatcaatttctaacatctgatataccagaattatttccatgcaattataaggggagggtaatatgatcaaagttaagcaatagtggtaaaatctttaaaactagattcttgcttctgatatgtttcaatacattgttgatggcattgtgccatttgagctgaaagcaggattttttttcattagtcatcaaaccaagaattttataattcttgacactttattatataatttacaattctatgccagatatggcaaatttcttcaatttcagtattttatagtttctacttgtaaaatatttttaataagaaaaattggtttgcataatctcagtgtttccttgagtagagatgttttaaatgtttatgttggaagcaattgtagttaattatattggcaatgaagcactttcaatgcctttttctacaagagccatttccagaagattattttgtttttggatttcacaatttaaatagttattttaatgattttctagcaaataatagagaataatgtttatgcttatgcagttagtctttattacagtaatttaaacaatgtggcacaaacatagttttttcatgctcttgtcatagacttttctttttaaccttctgcaaaagtaaaaactctcttagtaataatcatcatagggcaacaggatatagtatgtaactgcagtcttgagctgtctcttttcatgtattacctttcttgctcaacagctattcctgttttctgtaagatcctagtcagacagagccctcacaactggatagacctttctcaagggttagccctaaaatgtgacaagagaattggtttggctgaatcacaacaaataactagcaaagcttcagtgcttttgcaaactttttatgtaagcaaactttttgtgttatctggcacaggcctttgaaaagactataattctactttgtttaatgtagagtaactaatttttcaatttagaaagacagtgagaatccccaggataagcctctttatactcacttaaaccaactgggatggaattcagaatacctaagctgcttctttaacatagagatctttaaaaagggaaggtcaagcaaagaactgtaaccgaaagaagtaagagatttgaaaagacgatagagttaaaacaatatttaaaaaacatttctatttggtccatgcagttttatttgaaaatagtctgtcaaaatcagaactcctgaacaactttgaaagcagtaatattaactggtattcaaaaatgaataacagccaaaaatgaataacagccatttgatttatgtttccctcagtcatttggtttatgtttggttatggcaagatgttacagcatttatagttaatactactactaatatgtaaaccaaaagttaaatattctagttaaggattgtttctttaaacaactttcagattctgttgacattgtctttgtggtatttttatttcatgggttttaatttctcttaaagacttacctaaatattcagttacatttttaaaaaatctgtacgtgacagaatattaaaacatggaatatttttgcttcaa

SEQ ID NO: 31348 - DNA, 1549 bp, Homo sapiens
gtgtctgaaatgccccatgtccggtggtgccagcactagcccccatgtcggtctcagagaaccttctccccacctctgagttattctctcagtgtatcgaagatatcagtcaactatcttctggattgcattgatgctattgagaaggcagcctgcagtctaaaagtcatggttttaaaggcggaacacaccaggagccccagcgcaaccctcccctccaatgtgccttcatgccggtccctgtcatccagcgaagacggccccagtggcccttccagcctcgcagatggaggcctagcccacaacttacaggatagtgtcaggcaccgcatcctctacctctcagagcagctgagagtggagaaggccagtcgggatggcaacactgtgagctacctcaagctggtatccaaagcagaccggcaccaggtgccgcacatccagcaggcctttgagaaggtgaaccagcgcgcctctgccaccatcgcccagatcgagcacaggctccaccagtgtcaccagcagctccaggagctggaggaaggctgcaggcccgagggcttactgctgatggcagaaagcgacccagccaactgcgagccacccagtgagaaggccctgctttcagagccccccgagccaggtggggaagacgggccggtcaacctgcctcatgccagcaggcccttcatcttggagagtcgcttccagagcttacagcaggggacgtgcttagagacagaggatgtggcccagcaacaaaacctgctgttgcagaaggtaaaggcagagctggaagaagccaagaggttccacatcagcctccaggagtcctatcacagcctaaaggagaggtctctgactgacctgcagctgttgctggagtcccttcaggaggagaagtgtaggcaagcattgatggaagaacaggtgaatggtcgcctgcagggacagctgaatgagatttacaacctcaaacacaatctggcctgcagcgaagagagaatggcctatctatcctatgagagagccaaggaaatatgggagatcacggagaccttcaagagccgaatatccaagctggagatgctacagcaagtcacccaactggaggcagcggagcacctccaaagccgtcccccgcagatgttgttcaagttcctgagtccgcgcctctcactggcaaccgtcctcttggtctttgtctccaccttgtgtgcctgcccctcgtcactgatcagctcacgcctgtgcacctgcaccatgctgatgctgatcgggcttggggtcctggcctggcagaggtggcgcgccatccctgccacagactggcaggaatgggtcccctccaggtgtagactgtactccaaggactctgggcctccagcagatggaccttaaggggccaggagggccacctgccttagcttgctagctccctccctcctcctgggtgctgagggcatccagcaagcccctccacagctcttgcttgccgattatgtaaccaccagcctggtgaaatggatatagacgcccacctgcctca

SEQ ID NO: 31349 - DNA, 1549 bp, Homo sapiens
gaggcaagccccgtgtgattgttgaggaggagttagcccattgccagcctgtgacgtgactgactcgaatgaaccctgttattctctcagtgtatcgaagatatcagtcaactatcttctggattgcattgatgctattgagaaggcagcctgcagtctaaaagtcatggttttaaaggcggaacacaccaggagccccagcgcaaccctcccctccaatgtgccttcatgccggtccctgtcatccagcgaagacggccccagtggcccttccagcctcgcagatggaggcctagcccacaacttacaggatagtgtcaggcaccgcatcctctacctctcagagcagctgagagtggagaaggccagtcgggatggcaacactgtgagctacctcaagctggtatccaaagcagaccggcaccaggtgccgcacatccagcaggcctttgagaaggtgaaccagcgcgcctctgccaccatcgcccagatcgagcacaggctccaccagtgtcaccagcagctccaggagctggaggaaggctgcaggcccgagggcttactgctgatggcagaaagcgacccagccaactgcgagccacccagtgagaaggccctgctttcagagccccccgagccaggtggggaagacgggccggtcaacctgcctcatgccagcaggcccttcatcttggagagtcgcttccagagcttacagcaggggacgtgcttagagacagaggatgtggcccagcaacaaaacctgctgttgcagaaggtaaaggcagagctggaagaagccaagaggttccacatcagcctccaggagtcctatcacagcctaaaggagaggtctctgactgacctgcagctgttgctggagtcccttcaggaggagaagtgtaggcaagcattgatggaagaacaggtgaatggtcgcctgcagggacagctgaatgagatttacaacctcaaacacaatctggcctgcagcgaagagagaatggcctatctatcctatgagagagccaaggaaatatgggagatcacggagaccttcaagagccgaatatccaagctggagatgctacagcaagtcacccaactggaggcagcggagcacctccaaagccgtcccccgcagatgttgttcaagttcctgagtccgcgcctctcactggcaaccgtcctcttggtctttgtctccaccttgtgtgcctgcccctcgtcactgatcagctcacgcctgtgcacctgcaccatgctgatgctgatcgggcttggggtcctggcctggcagaggtggcgcgccatccctgccacagactggcaggaatgggtcccctccaggtgtagactgtactccaaggactctgggcctccagcagatggaccttaaggggccaggagggccacctgccttagcttgctagctccctccctcctcctgggtgctgagggcatccagcaagcccctccacagctcttgcttgccgattatgtaaccaccagcctggtgaaatggatatagacgcccacctgcctcaca

SEQ ID NO: 31350 - DNA, 1132 bp, Homo sapiens
atgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggtggaggtggtggcggaggaggagggcctcgtggagcggcgggaggaggcccagcgggcacagcaggctgtgcctggccctgggcccatgaccccagagtctgcaccggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtgggagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagg

SEQ ID NO: 31351 - DNA, 1160 bp, Homo sapiens
ggcccttcgcgcgcagtcccttagggggcgcctggaagcccggcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtgcaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcaccggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtgggagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagg

SEQ ID NO: 31352 - DNA, 3037 bp, Homo sapiens
gggcgtgcgcctgcgcggcgcggatgggccaggaaggggtccctcctaggtgccctgtaaggcaggcaggtagacgtacgcgtcgctccgtgcgtaggagcgcgcgcacggcttgtagaccccgcgagaaggaaggtcgagccaggttaccaccaaagaatatgattttggtctaggggctccagtttctgaagctgaaaactaccagaatactctccagctagaacaagaagtgagaaaccaagatagattcatctcgacactgaaattacagattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctgacacctgaaatgattcttcacatccctgagaaaggtcaaagttacaaactgatttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattctgttcactatctggagtaaataaagaagcttattaaaacagggaaaa

SEQ ID NO: 31353 - DNA, 2460 bp, Homo sapiens
gcgcaccgggcctgggggcgagcgggacggaagcaaagctggggcgccggggaggtggaagacgagccccactccggttaccaccaaagaatatgattttggtctaggggctccagtttctgaagctgaaaactaccagaatactctccagctagaacaagaagtgagaaaccaagatagattcatctcgacactgaaattacagattgatctcatttgccagcaaaataatattatagtattggaagatacaataaaaaggcttaaatctataattttagatactgaaaaagcacaaaataaatctccttctagacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaaga

SEQ ID NO: 31354 - DNA, 3878 bp, Homo sapiens
agaaggaggggcgcgcagggatcgcgcctagtctctccgcctgcggagccgtggggtcccggcagcccgcaggagtgctaagtaagggtccttcagggcgggaaccaggttccaggcagggacgcaggctacgttcgaataaaagtaccgaaggtcataaggccccagttcagatgggacttccccgcgtgacagcacagagataacggccagccctgggcgaaggttaccaccaaagaatatgattttggtctaggggctccagtttctgaagctgaaaactaccagaatactctccagctagaacaagaagtgagaaaccaagatagattcatctcgacactgaaattacaggcatttggatacctttgtgatagaaaaggcccttttcttcatccattgatggtttgatagtgggctgggaaggaaagctgtgttcctccacattaggcagcaaatacttgattgatttgatatttagcttagtcaaattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctgacacctgaaatgattcttcacatccctgagaaaggtcaaagttacaaactgatttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattctgttcactatctggagtaaataaagaagcttattaaaacagggaaaagtgtttttacaaaactgctttcctttcctttcttggtatctcaaataattggttggttaattttttttctttgtgatttgtgttttcatggctggaaaatctgtgccaaaatgggtacaacttactgatactggtctgggatctgatattccattttggaaccaaccttacatgaattccatgccataatctgatattgaagcagcagaaagtaggagtgttgtcagggttttaaaacctatagtattgtaccactcaaagactaagtaacatacatattctacaattgtgtttactactactgcttttagaaaggtaggtgatggtatatctgtcaagaatgtaagattttattaaaaatctttatttttaataagttttctttcaagtactgcaatcaacttaattgcgattttattttattgtctgtggcagctgtctgtaatctggagtaataagataagtgatgtttccttcctcccccaatttcctaaatctcttaccttatctatccataggctttgatgtaatgttcatattagagcctgaatgctactgtattttactgatataaactatttgtattcttgccattttaataaaaaaaggcttgtcattaatagta

SEQ ID NO: 31355 - DNA, 3036 bp, Homo sapiens
caggtatctaacctatctttgtatttttggaatttaatatagttcctgacataatcattgttcaatgggtctaattttttttttcctttaaaggcatttggatacctttgtgatagaaaaggcccttttcttcatccattgatggtttgatagtgggctgggaaggaaagctgtgttcctccacattaggcagcaaatacttgattgatttgatatttagcttagtcaaattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctataattttagatactgaaaaagcacaaaataaatctccttctagacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctgacacctgaaatgattcttcacatccctgagaaaggtcaaagttacaaactgatttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattctgttcactatctggagtaaataaagaagcttattaaaacagggaaaa

SEQ ID NO: 31356 - DNA, 2485 bp, Homo sapiens
gcgcaccgggcctgggggcgagcgggacggaagcaaagctggggcgccggggaggtggaagacgagccccactccggttaccaccaaagaatatgattttggtctaggggctccagtttctgaagctgaaaactaccagaatactctccagctagaacaagaagtgagaaaccaagatagattcatctcgacactgaaattacagattgatctcatttgccagcaaaataatattatagtattggaagatacaataaaaaggcttaaatctataattttagatactgaaaaagcacaaaataaatctccttctagacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctga

SEQ ID NO: 31357 - DNA, 1502 bp, Homo sapiens
agtcgcggggatgagctctgggcaggacggcgggccgaggagcccggggagggacccggagctccaggttaccaccaaagaatatgattttggtctaggggctccagtttctgaagctgaaaactaccagaatactctccagctagaacaagaagtgagaaaccaagatagattcatctcgacactgaaattacagattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaaacagtgtactgaggccctaattgtgtgtgaacaagacgtttccagaatgcgtcggcaattggatgagac

SEQ ID NO: 31358 - DNA, 2421 bp, Homo sapiens
caccgccaccgcccggtccaggcccaagcccaggccctgcgcggagcggagcggcgcggcgtccacccgggcccagccagccggcgcggcgggggcgggtccaggatcttcggcggatcttccattctcagggcgggagccggagtccgggcgcccgggatcgggctgggcccgcgcccatggcaagcgcggcctgcccgggccctggggaccctgccatgtgaggcaggcccgggctgggggcccggccatggccggggaacggcccccactgcggggccctgggcccgggcctggagaggtgccgggggaggggcccccggggccggggggcacgggcggaggcccgggccggggccgcccctcctcctaccgggctctccgcagcgccgtgtctagcctggcgcgtgtggacgattttcactgcgcggagaagatcggggccggcttcttctctgaggtctacaaggttcggcaccgacagtcagggcaagtcatggtgctgaagatgaacaagctccccagtaaccggggcaacacactacgggaagtgcagctgatgaaccggctcaggcaccccaacatcctaaggttcatgggagtctgtgtgcaccagggacagctgcacgctcttacagagtatatgaatggggggacattggaacagctgctcagctcccctgaacccctgtcctggccggtcaggctccacctggccctggacattgcccgaggcctgcggtacctgcactccaaaggtgtatttcaccgcgacctcacatccaagaactgtctagtccgacgggaagatcgaggcttcaccgctgtcgtgggtgacttcgggctggccgaaaagattcctgtgtatagggagggggcaaggaaggagccattggccgtggtgggctccccatactggatggctccagaggtgttacggggtgagctgtatgatgagaaggctgatgtctttgccttcgggattgtcctctgtgagctcatcgcccgagtacctgcagaccctgactacctaccacgcactgaggactttggcctggatgtgcctgctttccgaactctggtgggggatgactgcccactgcctttcttgctcctggccatccactgctgcaacctggaacccagcacccgtgcccccttcaccgaaattacccagcacctggaatggatcctggagcagctgcctgagccagccccactcaccaggaccgccctgacacacaatcagggctctgttgcaagagggggtccctctgccacgcttcccaggccagatccccggctttcccgaagccggtcagacctcttcctgcccccatcaccagaatcaccccccaactggggggacaatctgactcgagtcaaccccttctcactacgggaagacctcaggggtggcaagatcaagctcttagacacacccagcaagccagtcctgcctcttgtgccaccatcaccattcccatccactcagctgcccttggtgaccactccggagaccctggtccagcctgggacacctgcccgccgctgccgctcactaccctcatcccccgagctcccccgccgtatggagacagcactgccaggtcctggccctcccgctgtgggcccctcggctgaagagaagatggagtgcgagggcagcagccctgagccggaacctccagggccagcgccccagctgcctctggctgtggccacagacaacttcatcagcacctgttcctcggcctcccaaccctggtcccctagatcaggacccgtcctcaataacaatcccccagctgtggtggtgaactccccacaaggctgggctggggagccctggaaccgggcccagcatagcctgccccgggcggcagccctggagcggacagaaccctcgccacccccttcagctccccgggagcccgatgaggggctgccctgtcctggctgctgcctcggccccttcagctttggcttcctgtccatgtgcccccgccccacaccagctgttgcccgctaccgcaacctgaactgtgaggcgggcagtctcctctgccaccgagggcaccacgccaagccacccacacccagcctgcagctgcctggggcacgctcttagcagtggagcccgtggtctcaggcctccaactttggccttcaggacaccctgtaagaacagagcacacttgctggacagtgccagttccagatgggctgaccggctcttctccccgtgtaggggagccccagcatggactcaagggacagagcacttccagtcgaccccccggctcgcgttcccgtggggatcactgaaccagacacagcattgctgacacatgagactaacacgtgcaattatttaaaaagatttcaataaaactgcctggctggctccgggccgcccct

SEQ ID NO: 31359 - DNA, 2505 bp, Homo sapiens
agcggagcagccgccgcccgcccgcccgcccgcctccgcccgcggcaagccagcccgccggcgccccggagcgctgccgccaccgtcaccgccaccgcccggtccaggcccaagcccaggccctgcgcggagcggagcggcgcggcgtccacccgggcccagccagccggcgcggcgggggcgggtccaggatcttcggcggatcttccattctcagggcgggagccggagtccgggcgcccgggatcgggctgggcccgcgcccatggcaagcgcggcctgcccgggccctggggaccctgccatgtgaggcaggcccgggctgggggcccggccatggccggggaacggcccccactgcggggccctgggcccgggcctggagaggtgccgggggaggggcccccggggccggggggcacgggcggaggcccgggccggggccgcccctcctcctaccgggctctccgcagcgccgtgtctagcctggcgcgtgtggacgattttcactgcgcggagaagatcggggccggcttcttctctgaggtctacaaggttcggcaccgacagtcagggcaagtcatggtgctgaagatgaacaagctccccagtaaccggggcaacacactacgggaagtgcagctgatgaaccggctcaggcaccccaacatcctaaggttcatgggagtctgtgtgcaccagggacagctgcacgctcttacagagtatatgaatggggggacattggaacagctgctcagctcccctgaacccctgtcctggccggtcaggctccacctggccctggacattgcccgaggcctgcggtacctgcactccaaaggtgtatttcaccgcgacctcacatccaagaactgtctagtccgacgggaagatcgaggcttcaccgctgtcgtgggtgacttcgggctggccgaaaagattcctgtgtatagggagggggcaaggaaggagccattggccgtggtgggctccccatactggatggctccagaggtgttacggggtgagctgtatgatgagaaggctgatgtctttgccttcgggattgtcctctgtgagctcatcgcccgagtacctgcagaccctgactacctaccacgcactgaggactttggcctggatgtgcctgctttccgaactctggtgggggatgactgcccactgcctttcttgctcctggccatccactgctgcaacctggaacccagcacccgtgcccccttcaccgaaattacccagcacctggaatggatcctggagcagctgcctgagccagccccactcaccaggaccgccctgacacacaatcagggctctgttgcaagagggggtccctctgccacgcttcccaggccagatccccggctttcccgaagccggtcagacctcttcctgcccccatcaccagaatcaccccccaactggggggacaatctgactcgagtcaaccccttctcactacgggaagacctcaggggtggcaagatcaagctcttagacacacccagcaagccagtcctgcctcttgtgccaccatcaccattcccatccactcagctgcccttggtgaccactccggagaccctggtccagcctgggacacctgcccgccgctgccgctcactaccctcatcccccgagctcccccgccgtatggagacagcactgccaggtcctggccctcccgctgtgggcccctcggctgaagagaagatggagtgcgagggcagcagccctgagccggaacctccagggccagcgccccctgcctctggctgtggccacagacaacttcatcagcacctgttcctcggcctcccaaccctggtcccctagatcaggacccgtcctcaataacaatcccccagctgtggtggtgaactccccacaaggctgggctggggagccctggaaccgggcccagcatagcctgccccgggcggcagccctggagcggacagaaccctcgccacccccttcagctccccgggagcccgatgaggggctgccctgtcctggctgctgcctcggccccttcagctttggcttcctgtccatgtgcccccgccccacaccagctgttgcccgctaccgcaacctgaactgtgaggcgggcagtctcctctgccaccgagggcaccacgccaagccacccacacccagcctgcagctgcctggggcacgctcttagcagtggagcccgtggtctcaggcctccaactttggccttcaggacaccctgtaagaacagagcacacttgctggacagtgccagttccagatgggctgaccggctcttctccccgtgtaggggagccccagcatggactcaagggacagagcacttccagtcgaccccccggctcgcgttcccgtggggatcactgaaccagacacagcattgctgacacatgagactaacacgtgcaattatttaaaaagatttcaataaaactgcctggctggctccgggccgcccct

SEQ ID NO: 31360 - DNA, 1814 bp, Homo sapiens
tcaatggtaaggcagtgctgtggaaatctgtctgtgtaactggggtgctatgcaggcctgtctgggtgactgtcagggacaactgtcctaccacaccaaggacacagccctgggggtgcttttcttcatagccaaagaagctgcaggaaacccaccctagtgggacaaagaccaatgcagggtcagtccccacagccaggtgatgcaaacaggctggacgtgggccgcctcccctccagcttgacttgtgacagggaaaccaatgcagcagcagcagggccaccagagtcctgtcctggggacaggcttccttccagcgggcggggagtgggtgctcctgccagaccagcctggcttccacggttccagagaccctgttctccctcagcccagtccccgcccccactccttggctttatgagttcattggctgaagtcacccggagacaatgctgagtgttccacccctgagtcgaagcccagcccagggcagcccagccagacgcctccggtagtgtaaatgaggacaatgcctgctggcccacatgacggggggatgtagacggcagcggcgccagtcgctcctggcaccatggacgatgccacagtcctaaggaagaagggttacatcgtaggcatcaatcttggcaagggttcctacgcaaaagtcaaatctgcctactctgagcgcctcaagttcaatgtggctgtcaagatcatcgaccgcaagaaaacacctactgactttgtggagagattccttcctcgggagatggacatcctggcaactgtcaaccacggctccatcatcaagacttacgagatctttgagacctctgacggacggatctacatcatcatggagcttggcgtccagggcgacctcctcgagttcatcaagtgccagggagccctgcatgaggacgtggcacgcaagatgttccgacagctctcctccgccgtcaagtactgccacgacctggacatcgtccaccgggacctcaagtgcgagaaccttctcctcgacaaggacttcaacatcaagctgtctgactttggcttctccaagcgctgcctgcgggacagcaatgggcgcatcatcctcagcaagaccttctgcgggtcggcagcatatgcagcccccgaggtgctgcagagcatcccctaccagcccaaggtgtatgacatctggagcctgggcgtgatcctgtacatcatggtctgcggctccatgccctatgacgactccgacatcaggaagatgctgcgtatccagaaggagcaccgtgtggacttcccgcgctccaagaacctgacctgcgagtgcaaggacctcatctaccgcatgctgcagcccgacgtcagccagcggctccacatcgatgagatcctcagccactcgtggctgcagccccccaagcccaaagccacgtcttctgcctccttcaagagggagggggagggcaagtaccgcgctgagtgcaaactggacaccaagacaggcttgaggcccgaccaccggcccgaccacaagcttggagccaaaacccagcaccggctgctggtggtgcccgagaacgagaacaggatggaggacaggctggccgagacctccagggccaaagaccatcacatctccggagctgaggtggggaaagcaagcacctagcatgacaatggccccgttgtgtgtggtgggggtcggggttggggggcatggtgcagtcggccttcacgtaaactaagtaggcaggtaggatctgaagaaggcacaggtgcaagtaaaattcgtcaattaaaccactattttgatt

SEQ ID NO: 31361 - DNA, 1368 bp, Homo sapiens
cggggactggaggcctctggccatggcgcctggagacggggtcgcgcagaccccggacacccgaggggggcgcagcaggccagggcaacccgccgcgaggcggcgtccacgccgaggagccgcgcattcccggtccacacagacgcggcggagcgccctcccaggcgggactacaactcaatgcctggcacgggggcgggctcggcggtgacttaatccgggctgagtttggtggtggtagtgagggcaggtaggggcactgcccattttggccaagggtcacacagcatctacatcacaattgcaccggagtttaaaaatgtctggccctgtccctccccaccacccgccgctgtgtccagacagagaatgttctaacgctgggggcggctgcggatgaagtccttggggagaaaaggagcaggccaagggcgatggtggagtagagctgcctctcagaggcagcatgagctgagagggtgataggaaggcggcgctagacagcatggaggactttctgctctccaatgggtaccagctgggcaagaccattggggaagggacctactcaaaagtcaaagaagcattttccaaaaaacaccaaagaaaagtggcaattaaagttatagacaagatgggagggccagaagagtttatccagagattcctccctcgggagctccaaatcgtccgtaccctggaccacaagaacatcatccaggtgtatgagatgctggagtctgccgacgggaaaatctgcctggtgatggagctcgctgagggaggggatgtctttgactgcgtgctgaatggggggccactgcctgaaagccgggccaaggccctcttccgtcagatggttgaggccatccgctactgccatggctgtggtgtggcccaccgggacctcaaatgtgagaacgccttgttgcagggcttcaacctgaagctgactgactttggctttgccaaggtgttgcccaagtcacaccgggagctgagccagaccttctgcggcagtacagcctatgctgcccccgaggtgctgcagggcattccccacgatagcaaaaaaggtgatgtctggagcatgggtgtggtcctgtatgtcatgctctgtgccagcctaccttttgacgacacagacatccccaagatgctgtggcagcagcagaagggggtgtccttccccactcatctgagcatctcggccgattgccaggacctgctcaagaggctcctggaacccgatatgatcctccggccttcaattgaagaagttagttggcatccatggctagcaagcacttgataaaagcaatggcaagtgctctccaataaagtagggggagaaagcaaacccaaaaa

SEQ ID NO: 31362 - DNA, 1257 bp, Homo sapiens
tcctagtggagggctgagtccagcatcccagactcgtgtgactatataggcaagcatttggggacctacttcactttgataccctagccttcagcagctcaaggtgttggcctttggataggaggcttccaagtagtaaagctccctgctctcagcaagcccaacaccatggggaagggagatgtcttagaggcagcaccaaccaccacagcctaccattccctcatggatgaatatggttatgaggtgggcaaggccattggccatggctcctatgggtcggtatatgaggctttctacacaaagcagaaggttatggtggcagtcaagatcatctcaaagaagaaggcctctgatgactatcttaacaagttcctgccccgtgaaatacaggtaatgaaagtcttgcggcacaagtacctcatcaacttctatcgggccattgagagcacatctcgagtatacatcattctggaactggctcagggtggtgatgtccttgaatggatccagcgctacggggcctgctctgagccccttgctggcaagtggttctcccagctgaccctgggcattgcctacctgcacagcaagagcatcgtgcaccgggacttaaagttggagaacctgttgctggacaagtgggagaatgtgaagatatcagactttggctttgccaagatggtgccttctaaccagcctgtgggttgtagcccttcttaccgccaagtgaactgcttttcccacctcagccagacttactgtggcagctttgcttacgcttgcccagagatcttacgaggcttgccctacaaccctttcctgtctgacacctggagcatgggcgtcatcctttacactctagtggtcgcccatctgccctttgatgacaccaatctcaaaaagctgctaagagagactcagaaggaggtcactttcccagctaaccataccatctcccaggagtgcaagaacctgatcctccagatgctacgccaagccactaagcgtgccaccattctggacatcatcaaggattcctgggtgctcaagttccagcctgagcaacccacccatgagatcaggctgcttgaggccatgtgccagctccacaacaccactaaacagcaccaatccttgcaaattacgacctgaaaatggctgagggagggggctaagagaggagcaaagcaggaggtcttgggctaaaaatcttttttaccaaaaataaatctaagtctgatttagtttcatcaa

SEQ ID NO: 31363 - DNA, 1321 bp, Homo sapiens
aaaaagaactgcttctctttctttccccctccaagttcctagtggagggctgagtccagcatcccagactcgtgtgactatataggcaagcatttggggacctacttcactttgataccctagccttcagcagctcaaggtgttggcctttggataggaggcttccaagtagtaaagctccctgctctcagcaagcccaacaccatggggaagggagatgtcttagaggcagcaccaaccaccacagcctaccattccctcatggatgaatatggttatgaggtgggcaaggccattggccatggctcctatgggtcggtatatgaggctttctacacaaagcagaaggttatggtggcagtcaagatcatctcaaagaagaaggcctctgatgactatcttaacaagttcctgccccgtgaaatacaggtaatgaaagtcttgcggcacaagtacctcatcaacttctatcgggccattgagagcacatctcgagtatacatcattctggaactggctcagggtggtgatgtccttgaatggatccagcgctacggggcctgctctgagccccttgctggcaagtggttctcccagctgaccctgggcattgcctacctgcacagcaagagcatcgtgcaccgcctgatgcccagcctttctgctgctggtagggacttaaagttggagaacctgttgctggacaagtgggagaatgtgaagatatcagactttggctttgccaagatggtgccttctaaccagcctgtgggttgtagcccttcttaccgccaagtgaactgcttttcccacctcagccagacttactgtggcagctttgcttacgcttgcccagagatcttacgaggcttgccctacaaccctttcctgtctgacacctggagcatgggcgtcatcctttacactctagtggtcgcccatctgccctttgatgacaccaatctcaaaaagctgctaagagagactcagaaggaggtcactttcccagctaaccataccatctcccaggagtgcaagaacctgatcctccagatgctacgccaagccactaagcgtgccaccattctggacatcatcaaggattcctgggtgctcaagttccagcctgagcaacccacccatgagatcaggctgcttgaggccatgtgccagctccacaacaccactaaacagcaccaatccttgcaaattacgacctgaaaatggctgagggagggggctaagagaggagcaaagcaggaggtcttgggctaaaaatcttttttaccaaaaataaatctaagtctgatttagtttcatc

SEQ ID NO: 31364 - DNA, 896 bp, Homo sapiens
ctgcttctctttctttccccctccaagttcctagtggagggctgagtccagcatcccagactcgtgtgactatataggtaatgaaagtcttgcggcacaagtacctcatcaacttctatcgggccattgagagcacatctcgagtatacatcattctggaactggctcagggtggtgatgtccttgaatggatccagcgctacggggcctgctctgagccccttgctggcaagtggttctcccagctgaccctgggcattgcctacctgcacagcaagagcatcgtgcaccgggacttaaagttggagaacctgttgctggacaagtgggagaatgtgaagatatcagactttggctttgccaagatggtgccttctaaccagcctgtgggttgtagcccttcttaccgccaagtgaactgcttttcccacctcagccagacttactgtggcagctttgcttacgcttgcccagagatcttacgaggcttgccctacaaccctttcctgtctgacacctggagcatgggcgtcatcctttacactctagtggtcgcccatctgccctttgatgacaccaatctcaaaaagctgctaagagagactcagaaggaggtcactttcccagctaaccataccatctcccaggagtgcaagaacctgatcctccagatgctacgccaagccactaagcgtgccaccattctggacatcatcaaggattcctgggtgctcaagttccagcctgagcaacccacccatgagatcaggctgcttgaggccatgtgccagctccacaacaccactaaacagcaccaatccttgcaaattacgacctgaaaatggctgagggagggggctaagagaggagcaaagcaggaggtcttgggctaaaaa

SEQ ID NO: 31365 - DNA, 2513 bp, Homo sapiens
ttttgcccagacagggcgtgactcgccttggttcttgcattataggccctcgcgttcaccttgcctctggggtgttgcgcaggccagtcagaaactccgagctctcaaaggagccaggtgccccagttaaggccccttttcccgttttcgccccgtctagggactctacgcgaagcccagggctccacgtagtcacgggctgggtacatgatgttggggggcagctgctgctcgaagtcggactcaccccaatccctggaacggattctgctccctggtggtgatgggtatcccttgctagtggcctctcatcggaaactgaccattcaggatgattatgagtcacaaagcagggaggctagggtggccccggggcggggtcccggacccccaccctaaggcggagtgacgcccgcagtcacttcacaaggcaaaaattgttacggggcaataaaaggcacaacagcggccaatgtctggcagtgggcacatgggggtgcgggggtgtaggtgccaagcgccatggcttagacccgagattggagtccggccgccccccgacagcagccgcctcctgccccccgtgcgccctaggcgccaccatgtcgggagacaaacttctgagcgaactcggttataagctgggccgcacaattggagagggcagctactccaaggtgaaggtggccacatccaagaagtacaagggtaccgtggccatcaaggtggtggaccggcggcgagcgcccccggacttcgtcaacaagttcctgccgcgagagctgtccatcctgcggggcgtgcgacacccgcacatcgtgcacgtcttcgagttcatcgaggtgtgcaacgggaaactgtacatcgtgatggaagcggccgccaccgacctgctgcaagccgtgcagcgcaacgggcgcatccccggagttcaggcgcgcgacctctttgcgcagatcgccggcgccgtgcgctacctgcacgatcatcacctggtgcaccgcgacctcaagtgcgaaaacgtgctgctgagcccggacgagcgccgcgtcaagctcaccgacttcggcttcggccgccaggcccatggctacccagacctgagcaccacctactgcggctcagccgcctacgcgtcacccgaggtgctcctgggcatcccctacgaccccaagaagtacgatgtgtggagcatgggcgtcgtgctctacgtcatggtcaccgggtgcatgcccttcgacgactcggacatcgccggcctgccccggcgccagaaacgcggcgtgctctatcccgaaggcctcgagctgtccgagcgctgcaaggccctgatcgccgagctgctgcagttcagcccgtccgccaggccctccgcgggccaggtagcgcgcaactgctggctgcgcgccggggactccggctagaagccgggtggttccagccattcctgcagccaagggcactgggccagggcggcgcacgcgcaagaggcgcgcttcgagggaatatgcgaagctgccgcgtgctgctgcacatgcgctttttcccttccgcttccctccctttcttcccacgggggagtccgcagttgcccttgttcggaatccacgttccccgcgatcccgggagctggaggcgcatgcgcatccgcgattccctgcgaccaggccccgagagggcgagaccagaggggacggaagcattgcgcctgcgcggaactctcagcctctgcgcggagggcgtcccttcccaaccagccgtgggtgccaggttcccggttggaacctgcaataaactcgctgttcctcgcacctggctctaacggtggcccccatttgcggactagtggagaagcgatcgctccatccggggaaggcaggcgcgggtaccctattttagagtcacgcatgttgaggttattgctccaagactcaaaagggagtcgggaggattcgagcctggaccttttgagctccccagtatgggcaaactcaaaggagctttgttgtccccgggtcgtgatgtcgctgtgatgatgggctgggaagcaagtggaccccagcgcctcgccgtccacatcttttaagaatggaacagccaggggtggggcgagggtggcctgtctccacgtaaagtaggagtttatagataaggaaactgaggcccacatggatgtcacttgccaaaaggcagaggcatgagccacttcacccggctcacagctgtaatttgaacccagatctagcaacagtgacgttgcgggggtgggggaagccctccctgctgtgggtccctttcctctcgggaagagggggtgggggagtcagggcggggctgggcgagattcagctggactcactagctcgttccttcctctgttccttcatgtagtcatgcatttcttgagcacctactgtctgccaggccccagagctcatggcgaagagacttgggcccatccctgccgaaaacgagacaattgaaaagtcaagtaaaataaaagaatgacatgg

SEQ ID NO: 31366 - DNA, 2071 bp, Homo sapiens
actgccaccgccatgatgagtgtggcggaagcacttgagatggtccgcggcacggctaggaagtcccggacagtagtgtaactatccgaccgcgcgggaaagctctggcggcggaccctgggtaggaatgcgctgccgggctgcagctgaggggtctttactcctcttttgcccagacagggcgtgactcgccttggttcttgcattataggccctcgcgttcaccttgcctctggggtgttgcgcaggccagtcagaaactccgagctctcaaaggagccaggtgccccagttaaggccccttttcccgttttcgccccgtctagggactctacgcgaagcccagggctccacgtagtcacgggctgggtacatgatgttggggggcagctgctgctcgaagtcggactcaccccaatccctggaacggattctgctccctggtggtgatgggtatcccttgctagtggcctctcatcggaaactgaccattcaggatgattatgagtcacaaagcagggaggctagggtggccccggggcggggtcccggacccccaccctaaggcggagtgacgcccgcagtcacttcacaaggcaaaaattgttacggggcaataaaaggcacaacagcggccaatgtctggcagtgggcacatgggggtgcgggggtgtaggtgccaagcgccatggcttagacccgagattggagtccggccgccccccgacagcagccgcctcctgccccccgtgcgccctaggcgccaccatgtcgggagacaaacttctgagcgaactcggttataagctgggccgcacaattggagagggcagctactccaaggtgaaggtggccacatccaagaagtacaagggtaccgtggccatcaaggtggtggaccggcggcgagcgcccccggacttcgtcaacaagttcctgccgcgagagctgtccatcctgcggggcgtgcgacacccgcacatcgtgcacgtcttcgagttcatcgaggtgtgcaacgggaaactgtacatcgtgatggaagcggccgccaccgacctgctgcaagccgtgcagcgcaacgggcgcatccccggagttcaggcgcgcgacctctttgcgcagatcgccggcgccgtgcgctacctgcacgatcatcacctggtgcaccgcgacctcaagtgcgaaaacgtgctgctgagcccggacgagcgccgcgtcaagctcaccgacttcggcttcggccgccaggcccatggctacccagacctgagcaccacctactgcggctcagccgcctacgcgtcacccgaggtgctcctgggcatcccctacgaccccaagaagtacgatgtgtggagcatgggcgtcgtgctctacgtcatggtcaccgggtgcatgcccttcgacgactcggacatcgccggcctgccccggcgccagaaacgcggcgtgctctatcccgaaggcctcgagctgtccgagcgctgcaaggccctgatcgccgagctgctgcagttcagcccgtccgccaggccctccgcgggccaggtagcgcgcaactgctggctgcgcgccggggactccggctagaagccgggtggttccagccattcctgcagccaagggcactgggccagggcggcgcacgcgcaagaggcgcgcttcgagggaatatgcgaagctgccgcgtgctgctgcacatgcgctttttcccttccgcttccctccctttcttcccacgggggagtccgcagttgcccttgttcggaatccacgttccccgcgatcccgggagctggaggcgcatgcgcatccgcgattccctgcgaccaggccccgagagggcgagaccagaggggacggaagcattgcgcctgcgcggaactctcagcctctgcgcggagggcgtcccttcccaaccagccgtgggtgccaggttcccggttggaacctgcaataaactcgctgttcctcgcacctggctctaacggtggcccccatttgcggactagtggagaagcgatcgctccatccggggaaggcaggcgcgggtaccctattttagagtcac

SEQ ID NO: 31367 - DNA, 9288 bp, Homo sapiens
ggcgcgagttggaaagtttgcccgagggctggtgcaggcttggagctgggggccgtgcgctgccctgggaatgtgacccggccagcgaccaaaaccttgtgtgactgagctgaagagcagtgcatccagattctcctcagaagtgagactttccaaaggaccaatgactctgtttcctgcgccctttcattttttcctactctgtagctatgtctcgatcccgccatgcaaggccttccagattagtcaggaaggaagatgtaaacaaaaaaaagaaaaacagccaactacgaaagacaaccaagggagccaacaaaaatgtggcatcagtcaagactttaagccctggaaaattaaagcaattaattcaagaaagagatgttaagaaaaaaacagaacctaaaccacccgtgccagtcagaagccttctgacaagagctggagcagcacgcatgaatttggataggactgaggttctttttcagaacccagagtccttaacctgcaatgggtttacaatggcgctacgaagcacctctcttagcaggcgactctcccaacccccactggtcgtagccaaatccaaaaaggttccactttctaagggtttagaaaagcaacatgattgtgattataagatactccctgctttgggagtaaagcactcagaaaatgattcggttccaatgcaagacacccaagtccttcctgatatagagactctaattggtgtacaaaatccctctttacttaaaggtaagagccaagagacaactcagttttggtcccaaagagttgaggattccaagatcaatatccctacccacagtggccctgcagctgagatccttcctgggccactggaagggacacgctgtggtgaaggactattctctgaagagacattgaatgataccagtggttccccaaaaatgtttgctcaggacacagtgtgtgctccttttccccaaagagcaacccccaaagttacctctcaaggaaaccccagcattcagttagaagagttgggttcacgagtagaatctcttaagttatctgattcttacctggatcccattaaaagtgaacatgattgctaccccacctccagtcttaataaggttatacctgacttgaaccttagaaactgcttggctcttggtgggtctacgtctcctacctctgtaataaaattcctcttggcaggctcaaaacaagcgacccttggtgctaaaccagatcatcaagaggccttcgaagctactgcaaatcaacaggaagtttctgataccacctctttcctaggacaggcctttggtgctatcccacatcaatgggaacttcctggtgctgacccagttcatggtgaggccctgggtgagaccccagatctaccagagattcctggtgctattccagtccaaggagaggtctttggtactattttagaccaacaagaaactcttggtatgagtgggagtgttgtcccagacttgcctgtcttccttcctgttcctccaaatccaattgctacctttaatgctccttccaaatggcctgagccccaaagcactgtctcatatggacttgcagtccagggtgctatacagattttgcctttgggctcaggacacactcctcaatcatcatcaaactcagagaaaaattcattacctccagtaatggctataagcaatgtagaaaatgagaagcaggttcatataagcttcctgccagctaacactcaggggttcccattagcccctgagagaggactcttccatgcttcactgggtatagcccaactctctcaggctggtcctagcaaatcagacagagggagctcccaggtcagtgtaaccagcacagttcatgttgtcaacaccacagtggtgactatgccagtgccaatggtcagtacctcctcttcttcctataccactttgctaccgactttggaaaagaagaaaagaaagcgatgtggggtctgtgaaccctgccagcagaagaccaactgtggtgaatgcacttactgcaagaacagaaagaacagccatcagatctgtaagaaaagaaaatgtgaggagctgaaaaagaaaccatctgttgttgtgcctctggaggttataaaggaaaacaagaggccccagagggaaaagaagcccaaagttttaaaggcagattttgacaacaaaccagtaaatggccccaagtcagaatccatggactacagtagatgtggtcatggggaagaacaaaaattggaattgaacccacatactgttgaaaatgtaactaaaaatgaagacagcatgacaggcatcgaggtggagaagtggacacaaaacaagaaatcacagttaactgatcacgtgaaaggagattttagtgctaatgtcccagaagctgaaaaatcgaaaaactctgaagttgacaagaaacgaaccaaatctccaaaattgtttgtacaaaccgtaagaaatggcattaaacatgtacactgtttaccagctgaaacaaatgtttcatttaaaaaattcaatattgaagaattcggcaagacattggaaaacaattcttataaattcctaaaagacactgcaaaccataaaaacgctatgagctctgttgctactgatatgagttgtgatcatctcaaggggagaagtaacgttttagtattccagcagcctggctttaactgcagttccattccacattcttcacactccatcataaatcatcatgctagtatacacaatgaaggtgatcaaccaaaaactcctgagaatataccaagtaaagaaccaaaagatggatctcccgttcaaccaagtctcttatcgttaatgaaagataggagattaacattggagcaagtggtagccatagaggccctgactcaactctcagaagccccatcagagaattcctccccatcaaagtcagagaaggatgaggaatcagagcagagaacagccagtttgcttaatagctgcaaagctatcctctacactgtaagaaaagacctccaagacccaaacttacagggagagccaccaaaacttaatcactgtccatctttggaaaaacaaagttcatgcaacacggtggttttcaatgggcaaactactaccctttccaactcacatatcaactcagctactaaccaagcatccacaaagtcacatgaatattcaaaagtcacaaattcattatctctttttataccaaaatcaaattcatccaagattgacaccaataaaagtattgctcaagggataattactcttgacaattgttccaatgatttgcatcagttgccaccaagaaataatgaagtggagtattgcaaccagttactggacagcagcaaaaaattggactcagatgatctatcatgtcaggatgcaacccatacccaaattgaggaagatgttgcaacacagttgacacaacttgcttcgataattaagatcaattatataaaaccagaggacaaaaaagttgaaagtacaccaacaagccttgtcacatgtaatgtacagcaaaaatacaatcaggagaagggcacaatacaacagaaaccaccttcaagtgtacacaataatcatggttcatcattaacaaaacaaaagaacccaacccagaaaaagacaaaatccaccccatcaagagatcggcggaaaaagaagcccacagttgtaagttatcaagaaaatgatcggcagaagtgggaaaagttgtcctatatgtatggcacaatatgcgacatttggatagcatcgaaatttcaaaattttgggcaattttgtccacatgattttcctactgtatttgggaaaatttcttcctcgaccaaaatatggaaaccactggctcaaacgaggtccattatgcaacccaaaacagtatttccaccactcactcagataaaattacagagatatcctgaatcagcagaggaaaaggtgaaggttgaaccattggattcactcagcttatttcatcttaaaacggaatccaacgggaaggcattcactgataaagcttataattctcaggtacagttaacggtgaatgccaatcagaaagcccatcctttgacccagccctcctctccacctaaccagtgtgctaacgtgatggcaggcgatgaccaaatacggtttcagcaggttgttaaggagcaactcatgcatcagagactgccaacattgcctggtatctctcatgaaacacccttaccggagtcagcactaactctcaggaatgtaaatgtagtgtgttcaggtggaattacagtggtttctaccaaaagtgaagaggaagtctgttcatccagttttggaacatcagaattttccacagtggacagtgcacagaaaaattttaatgattatgccatgaacttctttactaaccctacaaaaaacctagtgtctataactaaagattctgaactgcccacctgcagctgtcttgatcgagttatacaaaaagacaaaggcccatattatacacaccttggggcaggaccaagtgttgctgctgtcagggaaatcatggagaataggtatggtcaaaaaggaaacgcaataaggatagaaatagtagtgtacaccggtaaagaagggaaaagctctcatgggtgtccaattgctaagtgggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaatcgtacctgtacatgtcaaggaattgatccagagacttgtggagcttcattctcttttggctgttcatggagtatgtactttaatggctgtaagtttggtagaagcccaagccccagaagatttagaattgatccaagctctcccttacatgaaaaaaaccttgaagataacttacagagtttggctacacgattagctccaatttataagcagtatgctccagtagcttaccaaaatcaggtggaatatgaaaatgttgcccgagaatgtcggcttggcagcaaggaaggtcgtcccttctctggggtcactgcttgcctggacttctgtgctcatccccacagggacattcacaacatgaataatggaagcactgtggtttgtaccttaactcgagaagataaccgctctttgggtgttattcctcaagatgagcagctccatgtgctacctctttataagctttcagacacagatgagtttggctccaaggaaggaatggaagccaagatcaaatctggggccatcgaggtcctggcaccccgccgcaaaaaaagaacgtgtttcactcagcctgttccccgttctggaaagaagagggctgcgatgatgacagaggttcttgcacataagataagggcagtggaaaagaaacctattccccgaatcaagcggaagaataactcaacaacaacaaacaacagtaagccttcgtcactgccaaccttagggagtaacactgagaccgtgcaacctgaagtaaaaagtgaaaccgaaccccattttatcttaaaaagttcagacaacactaaaacttattcgctgatgccatccgctcctcacccagtgaaagaggcatctccaggcttctcctggtccccgaagactgcttcagccacaccagctccactgaagaatgacgcaacagcctcatgcgggttttcagaaagaagcagcactccccactgtacgatgccttcgggaagactcagtggtgccaatgcagctgctgctgatggccctggcatttcacagcttggcgaagtggctcctctccccaccctgtctgctcctgtgatggagcccctcattaattctgagccttccactggtgtgactgagccgctaacgcctcatcagccaaaccaccagccctccttcctcacctctcctcaagaccttgcctcttctccaatggaagaagatgagcagcattctgaagcagatgagcctccatcagacgaacccctatctgatgaccccctgtcacctgctgaggagaaattgccccacattgatgagtattggtcagacagtgagcacatctttttggatgcaaatattggtggggtggccatcgcacctgctcacggctcggttttgattgagtgtgcccggcgagagctgcacgctaccactcctgttgagcaccccaaccgtaatcatccaacccgcctctcccttgtcttttaccagcacaaaaacctaaataagccccaacatggttttgaactaaacaagattaagtttgaggctaaagaagctaagaataagaaaatgaaggcctcagagcaaaaagaccaggcagctaatgaaggtccagaacagtcctctgaagtaaatgaattgaaccaaattccttctcataaagcattaacattaacccatgacaatgttgtcaccgtgtccccttatgctctcacacacgttgcggggccctataaccattgggtctgaaggcttttctccccctcttaatgcctttgctagtgcagtgtattttttcaaggtgctgttaaaagaaagtcatgttgtcgtttactatcttcatctcacccatttcaagtctgaggtaaaaaaataataatgataacaaaacggggtgggtattcttaactgtgactatattttgacaattggtagaaggtgcacattttaagcaaaaataaaagttttatagttttaaatacataaagaaatgtttcagttaggcattaaccttgatagaatcactcagtttggtgctttaaattaagtctgtttactatgaaacaagagtcatttttagaggattttaacaggttcatgttctatgatgtaaaatcaagacacacagtgttaactctacacagcttctggtgcttaaccacatccacacagttaaaaataagctgaattattatttcatggtgccattgttccaacatcttccaatcattgctagaaaattggcatattcctttgaaataaacttatgaaatgttttctctcttaaaatatttctcctgtgtaaaataaatcattgttgttagtaatggttggaggctgttcataaattgtaaatatatattttaaaagcactttctatttttaaaagtaacttgaaataatatagtataagaatcctattgtctattgtttgtgcatatttgcatacaagagaaatcatttatccttgctgtgtagagttccatcttgttaactgcagtatgtattctaatcatgtatatggtttgtgttcttttactgtgtcctctcacattcaagtattagcaacttgcagtatataaaatagttagataatgagaagttgttaattatctctaaaattggaattaggaagcatatcaccaatactgattaacattctctttggaactaggtaagagtggtctcttcttattgaacaacctcaatttagtttcatcccacctttctcagtataatccatgagaggtgtttccaaaaggagatgagggaacaggataggtttcagaagagtcaaatgcttctaatgtctcaaggtgataaaatacaaaaactaagtagacagatatttgtactgaagtctgatacagaattagaaaaaaaaaattcttgttgaaatattttgaaaacaaattccctactatcatcacatgcctccccaaccccaagtcaaaaacaagaggaatggtactacaaacatggctttgtccattaagagctaattcatttgtttatcttagcatactagatttgggaaaatgataactcatcttttctgataattgcctatgttctaggtaacaggaaaacaggcattaagtttattttagtcttcccattttcttcctattactttattgactcattttattgcaaaacaaaaaggattacccaaacaacatgtttcgaacaaggagaattttcaatgaaatacttgattctgttaaaatgcagaggtgctataacattcaaagtgtcagattccttgggagtatggaaaacctaatggtgcttctcccttggaaatgccataggaagcccacaaccgctaacacttacaattttggtgcaaaagcaaacagttccagcaggctctctaaagaaaaactcattgtaacttattaaaataatatctggtgcaaagtatctgttttgagcttttgactaatccaagtaaaggaatatgaagggattgtaaaaaacaaaatgtccattgatagaccatcgtgtacaagtagatttctgcttgttgaatatgtaaaatagggtaattcattgacttgttttagtattttgtgtgccttagatttccgttttaagacatgtatatttttgtgagcctaaggtttcttatatacatataagtatataaataagtgattgtttattgcttcagctgcttcaacaagatatttactagtattagactatcaggaatacacccttgcgagattatgttttagattttaggccttagctcccactagaaattatttcttcaccagatttaatggataaagttttatggctctttatgcatccactcatctactcattcttcgagtctacacttattgaatgcctgcaaaatctaagtatcacttttatttttctttggatcaccacctatgacatagtaaacttgaagaataaaaactaccctcagaaatatttttaaaagaagtagcaaattatcttcagtataatccatggtaatgtatgcagtaattcaaattgatctctctctcaataggtttcttaacaatctaaacttgaaacatcaatgttaatttttggaactattgggatttgtgacgcttgttgcagtttaccaaaacaagtatttgaaaatatatagtatcaactgaaatgtttccattccgttgttgtagttaacatcatgaatggacttcttaagctgattaccccactgtgggaaccaaattggattcctactttgttggactctctttcctgattttaacaatttaccatcccattctctgccctgtgattttttttaaaagcttattcaatgttctgcagcattgtgattgtatgctggctacactgcttttagaatgctctttctcatgaagcaaggaaataaatttgtttgaaatgacattttctctca

SEQ ID NO: 31368 - DNA, 668 bp, Homo sapiens
aagattctgaactgcccacctgcagctgtcttgatcgagttatacaaaaagacaaaggcccatattatacacaccttggggcaggaccaagtgttgctgctgtcagggaaatcatggagaataggtatggtcaaaaaggaaacgcaataaggatagaaatagtagtgtacaccggtaaagaagggaaaagctctcatgggtgtccaattgctaagtgggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaatcgtacctgtacatgtcaaggaattgatccagagacttgtggagcttcattctcttttggctgttcatggagtatgtactttaatggctgtaagtttggtagaagcccaagccccagaagatttagaattgatccaagctctcccttacatacctactatgaaagaattactaaaggacgtaatccagaaagaagatatatgaaaccggaacgaatcagtccgggacacgaggccatg

SEQ ID NO: 31369 - DNA, 1615 bp, Homo sapiens
agacacacacaccagcagctacacctacacgctgaccatcacaggcacacagaggcacatccacctcacatccacctcatacttgtgtactctcagggttcagtctttcatcctatccctctctgatctgtgcctcccaataccttccaagatgtttacagagacccttctccctgtgcagttaggagtgtaaggcaagagagcccctacttcatggggcagatcaagagctgagaccaaagatggtctatgttgctgaccttgtcctgtcctcctgctgtcttaaactatgatccctgctgcggtcactgaagcctttccctgtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgtt

SEQ ID NO: 31370 - DNA, 2796 bp, Homo sapiens
aagcctgcttctctatgcttataacccagcctccattccttcgacgccaccattttaaagggatttactgcacggacttctcccaagttcctaggcattatcttctggaccctatcctgcagaggtgaagcgtccctttggggactctcgctgggtgagagggacaagaaacacccactaggacccaaccccggcagccagcggctcgagcatgcgctgagagtttgtgcagctggccctggctgccgccgctgcctcgtccggactcggagaggacttgggagggacagcggcgctgggaggtggcttagcagagactttccagcaactgctgcccaggacttttttttttttttttctttttcccaggaggcggcgacggcggcggcggggggagaggaagagaaagaagcgtctccagctgaagccaatgcagccctccggctctccgcgaagaagttccctgccccgatgagcccccgccgtgcgtccccgactatccccaggcgggcgtggggcaccgggcccagcgccgacgatcgctgccgttttgcccttgggagtaggatgtggtgaaaggatggggcttctcccttacggggctcacaatggccagagaagattccgtgaagtgtctgcgctgcctgctctacgccctcaatctgctcttttggttaatgtccatcagtgtgttggcagtttctgcttggatgagggactacctaaataatgttctcactttaactgcagaaacgagggtagaggaagcagtcattttgacttactttcctgtggttcatccggtcatgattgctgtttgctgtttccttatcattgtggggatgttaggatattgtggaacggtgaaaagaaatctgttgcttcttgcatggtactttggaagtttgcttgtcattttctgtgtagaactggcttgtggcgtttggacatatgaacaggaacttatggttccagtacaatggtcagatatggtcactttgaaagccaggatgacaaattatggattacctagatatcggtggcttactcatgcttggaatttttttcagagagagtttaagtgctgtggagtagtatatttcactgactggttggaaatgacagagatggactggcccccagattcctgctgtgttagagaattcccaggatgttccaaacaggcccaccaggaagatctcagtgacctttatcaagagggttgtgggaagaaaatgtattcctttttgagaggaaccaaacaactgcaggtgctgaggtttctgggaatctccattggggtgacacaaatcctggccatgattctcaccattactctgctctgggctctgtattatgatagaagggagccggggacagaccaaatgatgtccttgaagaatgacaactctcagcacctgtcatgtccctcagtagaactgttgaaaccaagcctgtcaagaatctttgaacacacatccatggcaaacagctttaatacacactttgagatggaggagttataaaaagaaatgtcacagaagaaaaccacaaacttgttttactggacttgtgaatttttgagtacatactatgtgtttcagaaatatgtagaaataaaaatgttgccataaaataacacctaagcatatactattctatgctttaaaatgaggatggaaaagtttcatgtcataagtcaccacctggacaataattgatgcccttaaaatgctgaagacagatgtcatacccactgtgtagcctgtgtatgacttttactgaacacagttatgttttgaggcagcatggtttgattagcatttccgcatccatgcaaacgagtcacatatggtgggactggagccatagtaaaggttgatttacttctaccaactagtatataaagtactaattaaatgctaacataggaagttagaaaatactaataacttttattactcagcgatctattcttctgatgctaaataaattatatatcagaaaactttcaatattggtgactacctaaatgtgatttttgctggttactaaaatattcttaccacttaaaagagcaagctaacacattgtcttaagctgatcagggattttttgtatataagtctgtgttaaatctgtataattcagtcgatttcagttctgataatgttaagaataaccattatgaaaaggaaaatttgtcctgtatagcatcattatttttagcctttcctgttaataaagctttactattctgtcctgggcttatattacacatataactgttatttaaatacttaaccactaattttgaaaattaccagtgtgatacataggaatcattattcagaatgtagtctggtctttaggaagtattaataagaaaatttgcacataacttagttgattcagaaaggacttgtatgctgtttttctcccaaatgaagactctttttgacactaaacactttttaaaaagcttatctttgccttctccaaacaagaagcaatagtctccaagtcaatataaattctacagaaaatagtgttctttttctccagaaaaatgcttgtgagaatcattaaaacatgtgacaatttagagattctttgttttatttcactgattaatatactgtggcaaattacacagattattaaatttttttacaagagtatagtatatttatttgaaatgggaaaagtgcattttactgtattttgtgtattttgtttatttctcagaatatggaaagaaaattaaaatgtgtcaataaatattttctagagagt

SEQ ID NO: 31371 - DNA, 1495 bp, Homo sapiens
attccttcgacgccaccattttaaagggatttactgcacggacttctcccaagttcctaggcattatcttctggaccctatcctgcagaggtgaagcgtccctttggggactctcgctgggaggcggcgacggcggcggcggggggagaggaagagaaagaagcgtctccagctgaagccaatgcagccctccggctctccgcgaagaagttccctgccccgatgagcccccgccgtgcgtccccgactatccccaggcgggcgtggggcaccgggcccagcgccgacgatcgctgccgttttgcccttgggagtaggatgtggtgaaaggatggggcttctcccttacggggctcacaatggccagagaagattccgtgaagtgtctgcgctgcctgctctacgccctcaatctgctcttttggttaatgtccatcagtgtgttggcagtttctgcttggatgagggactacctaaataatgttctcactttaactgcagaaacgagggtagaggaagcagtcattttgacttactttcctgtggttcatccggtcatgattgctgtttgctgtttccttatcattgtggggatgttaggatattgtggaacggtgaaaagaaatctgttgcttcttgcatggtactttggaagtttgcttgtcattttctgtgtagaactggcttgtggcgtttggacatatgaacaggaacttatggttccagtacaatggtcagatatggtcactttgaaagccaggatgacaaattatggattacctagatatcggtggcttactcatgcttggaatttttttcagagagagtttaagtgctgtggagtagtatatttcactgactggttggaaatgacagagatggactggcccccagattcctgctgtgttagagaattcccaggatgttccaaacaggcccaccaggaagatctcagtgacctttatcaagagggttgtgggaagaaaatgtattcctttttgagaggaaccaaacaactgcaggtgctgaggtttctgggaatctccattggggtgacacaaatcctggccatgattctcaccattactctgctctgggctctgtattatgatagaagggagccggggacagaccaaatgatgtccttgaagaatgacaactctcagcacctgtcatgtccctcagtagaactgttgaaaccaagcctgtcaagaatctttgaacacacatccatggcaaacagctttaatacacactttgagatggaggagttataaaaagaaatgtcacagaagaaaaccacaaacttgttttactggacttgtgaatttttgagtacatactatgtgtttcagaaatatgtagaaataaaaatgttgccataaaataacacctaagcatatactattctatgctttaaaatgaggatggaaaagtttcatgtcataagtcaccacctggacaataattgatgcccttaaaatgctgaagacag

SEQ ID NO: 31372 - DNA, 569 bp, Homo sapiens
agtgccgagcacagctgtcctcgaggaggggcgtggagtgagggaggttttcaagagcgtctcatcagaatgcacagggctccgccgcgtgtcccctgagaacgcgagtttactgtgcgacttcattcatccggatagttgctcttttcttttcccagcagatcgctgccgttttgcccttgggagtaggatgtggtgaaaggatggggcttctcccttacggggctcacaatggccagagaagattccgtgaagtgtctgcgctgcctgctctacgccctcaatctgctcttttggttaatgtccatcagtgtgttggcagtttctgcttggatgagggactacctaaataatgttctcactttaactgcagaaacgagggtagaggaagcagtcattttgacttactttcctgtggttcatccggtcatgattgctgtttgctgtttccttatcattgtggggatgttaggatattgtggaacggtgaaaagaaatctgttgcttcttgcatggtactttggaagtttgcttgtcattttctgtgtagaactggcttgtggcgtttg

SEQ ID NO: 31373 - DNA, 693 bp, Homo sapiens
accccttcaccccccttctcaaacacaaatattatcatataataaaagcctgcttctctatgcttataacccagcctccattccttcgacgccaccattttaaagggatttactgcacggacttctcccaagttcctaggcattatcttctggaccctatcctgcagaggaggcggcgacggcggcggcggggggagaggaagagaaagaagcgtctccagctgaagccaatgcagccctccggctctccgcgaagaagttccctgccccgatgagcccccgccgtgcgtccccgactatccccaggcgggcgtggggcaccgggcccagcgccgacgatcgctgccgttttgcccttgggagtaggatgtggtgaaaggatggggcttctcccttacggggctcacaatggccagagaagattccgtgaagtgtctgcgctgcctgctctacgccctcaatctgctcttttggttaatgtccatcagtgtgttggcagtttctgcttggatgagggactacctaaataatgttctcactttaactgcagaaacgagggtagaggaagcagtcattttgacttactttcctgtggttcatccggtcatgattgctgtttgctgtttccttatcattgtggggatgttaggatattgtggaacggtgaaaagaaatctgttgcttcttgcatgg

SEQ ID NO: 31374 - DNA, 551 bp, Homo sapiens
attcacacccgagctgcgggacggggtagaggggtgcggagttggagtgcccaggaactgtcctaactagaagggcgctcattctctcgggcttgccggtggcgcctctgacgtgtccgggatcgctgccgttttgcccttgggagtaggatgtggtgaaaggatggggcttctcccttacggggctcacaatggccagagaagattccgtgaagtgtctgcgctgcctgctctacgccctcaatctgctcttttggttaatgtccatcagtgtgttggcagtttctgcttggatgagggactacctaaataatgttctcactttaactgcagaaacgagggtagaggaagcagtcattttgacttactttcctgtggttcatccggtcatgattgctgtttgctgtttccttatcattgtggggatgttaggatattgtggaacggtgaaaagaaatctgttgcttcttgcatggtactttggaagtttgcttgtcattttctgtgtagaactggcttgtggcgtttggacatatgaacaggaacttatg

SEQ ID NO: 31375 - DNA, 551 bp, Homo sapiens
agggctccgccgcgtgtcccctgagaacgcgagtttactatcgctgccgttttgcccttgggagtaggatgtggtgaaaggatggggcttctcccttacggggctcacaatggccagagaagattccgtgaagtgtctgcgctgcctgctctacgccctcaatctgctcttttggttaatgtccatcagtgtgttggcagtttctgcttggatgagggactacctaaataatgttctcactttaactgcagaaacgagggtagaggaagcagtcattttgacttactttcctgtggttcatccggtcatgattgctgtttgctgtttccttatcattgtggggatgttaggatattgtggaacggtgaaaagaaatctgttgcttcttgcatggtactttggaagtttgcttgtcattttctgtgtagaactggcttgtggcgtttggacatatgaacaggaacttatggttccagtacaatggtcagatatggtcactttgaaagccaggatgacaaattatggattacctagatatcggtggcttactc

SEQ ID NO: 31376 - DNA, 1698 bp, Homo sapiens
cggagagaacgccggtggcggggctggtagcccggcagccgcaggtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacgggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaacaataaaaacatgtttttttttttttttttt

SEQ ID NO: 31377 - DNA, 582 bp, Homo sapiens
atggggcgcttccgcgggggcctgcggtgcatcaagtacctgctgcttggcttcaacctgctcttctggctggctggatcggccgtcattgcttttggactatggtttcggttcggaggtgccataaaggagttatcatcagaggacaagtccccagagtatttctatgtggggctgtatgttctggttggagccggggccctgatgatggccgtggggttcttcgggtgctgcggagccatgcgggagtcgcaatgtgtgcttggatcattttttacctgcctcctggtgatatttgctgctgaagtaaccactggagtatttgcttttataggcaagggggtagctatccgacatgttcagaccatgtatgaagaggcttacaatgattaccttaaagacaggggaaaaggcaatgggacactcatcaccttccactcaacatttcagtgctgtggaaaagaaagctccgaacaggtccaacctacatgcccaaaggagcttctaggacacaagatctttggcatgatattcagcatggtcctctgctgtgcgatacgaaactcacgagatgtgatatga

SEQ ID NO: 31378 - DNA, 793 bp, Homo sapiens
ggagcctgccgctccccgcgctcgtagcgcgggcctggggactggggatcccgccgccgggccgcagcatggggcgcttccgcgggggcctgcggtgcatcaagtacctgctgcttggcttcaacctgctcttctggctggctggatcggccgtcattgcttttggactatggtttcggttcggaggtgccataaaggagttatcatcagaggacaagtccccagagtatttctatgtggggctgtatgttctggttggagccggggccctgatgatggccgtggggttcttcgggtgctgcggagccatgcgggagtcgcaatgtgtgcttggatcagctatccgacatgttcagaccatgtatgaagaggcttacaatgattaccttaaagacaggggaaaaggcaatgggacactcatcaccttccactcaacatttcagtgctgtggaaaagaaagctccgaacaggtccaacctacatgcccaaaggagcttctaggacacaagaattgcatcgatgaaattgagaccataatcagtgttaagctccagctcattggaattgtcggtattggaattgcaggtctgacgatctttggcatgatattcagcatggtcctctgctgtgcgatacgaaactcacgagatgtgatatgaagctacttctacatgaaaattgcaatctaaagctttcataccaaatgtcacaggagctgtctcccagctcatttttaacactgaaatgacattaggatctaaaataatttgctgtcaattgtacatttgcatga

SEQ ID NO: 31379 - DNA, 3177 bp, Homo sapiens
ggggactggggatcccgccgccgggccgcagcatggggcgcttccgcgggggcctgcggtgcatcaagtacctgctgcttggcttcaacctgctcttctggctggctggatcggccgtcattgcttttggactatggtttcggttcggaggtgccataaaggagttatcatcagaggacaagtccccagagtatttctatgtggggctgtatgttctggttggagccggggccctgatgatggccgtggggttcttcgggtgctgcggagccatgcgggagtcgcaatgtgtgcttggatcattttttacctgcctcctggtgatatttgctgctgaagtaaccactggagtatttgcttttataggcaagggggtagctatccgacatgttcagaccatgtatgaagaggcttacaatgattaccttaaagacaggggaaaaggcaatgggacactcatcaccttccactcaacatttcagtgctgtggaaaagaaagctccgaacaggtccaacctacatgcccaaaggagcttctaggacacaagaattgcatcgatgaaattgagaccataatcagtgttaagctccagctcattggaattgtcggtattggaattgcaggtctgacgatctttggcatgatattcagcatggtcctctgctgtgcgatacgaaactcacgagatgtgatatgaagctacttctacatgaaaattgcaatctaaagctttcataccaaatgtcacaggagctgtctcccagctcatttttaacactgaaatgacattaggatctaaaataatttgctgtcaattgtacatttgcatgagtacgtatgtttggctcattactggtttaccccttgagtgaatgcctgtttatgatgactgagagcatattcatgtgtgatctgcgtgtttctggaatatgctttatacgtaatgaaatctgtttgctgggaattcctgattcttgttatataagaagaacaacctatttcgctcccagaaaaaaaagatcaaagagctttcagaaactttgagaacttggctatttagaaaaagtgataatgggtcagtttctcagactgtagccattgaaaattagatgcagagaattcagagatttcttcttaatggaagtaataagctgtaagaattgagagatcacaatggagtgttaaaactgactgtgtctaagttgggtgtaagggtttcctgggtttttttatatacatgctctccccagaatacagtaaaccacagttttagaactaaacacatctgtaaaactaaatatagcatggaaaatccaatttgaataagtcatgctttcctagaatttaaaaataaaaaagtcttcctctggaaagagaagtcacacagacaatcatgtgccctataaaagtgagtgtttataggactaaaaaacttttaacaactttttaaggaaatatttttgttcttatacaaaaacatgtaaatattgctttattactttcattttctgaccctgctgtaaactactgcaaccctcacatcctcaaagggacttttatgtcaaactcttctgtttctccaaatataaggaaaaaagactaaagcaagagatctggcagttgaaaattgtgggaaagagaatttgtatgggcactgtatctatgaaatacctcataacttacgtttacatgttttcctaactttttgtatttttcttgtatagccacctagagaattcttcatagattaagaactacagttttcaccacttaacataagtaaaacaaagtccttcataatttaaccattagcatctttggccaaaccaaaataaagaaaagcatcttctcctagttgtgtgtgggcaacagaaacaagttaaggaaacaaaaatacttatatatacacagaacaaaaataatgttctttttatgcaaatcccctgtgaaaataaaattttcaatgtttttttggtcttaacgcttcattttaacttagtaaacccaaatttaggatttacattggcaaatttttcagtgatttttaacgtgttacatttagtaaaccatagattttttaaaaactacattttgtaaggccacacataagtgaaaatacggaaggctttggaaacccccagatgaacttctatacatgtgaaaacacaagtctttgagtgtgcactaaaagtgtcacactcccaaaaaactcacaaaacattttgctaaaaagatatgactgcttgaaatagtctctctcccatggagaaccacatttctctttctgccatacttgctactgctactgattttggaggaaatttttctagaagaacaaaggtcatatttgaggcaagctaaaaacttaattatacatggctactttactgtgtctgtagctaaagaaaaattattttacaaaaattacttcatgaaatatagtttgtaccccagtagttgagaaatgtgaccttttaggcaaagaacaggcagtccatctctcttagctttagtttatctctctgcctgaagacaggaaacaggcccaagtgcatactcgggttctttccaactcagaatcatctctgattccacaaaagtgagtttagtttcctatctgaattaacaactttaaaggagactataatagttaaaagtggaagaatagaaataaataaatttaaaatgaaattaattaaagtagaagagaagggttctgttccatgtacgattaatgtgccccttttggagataagctttccaaaatatgcgtatgagtaaaattagagaattccaccactaagcaacaatagattttatatgtgtgtgtggatatatatacacacacacacagaaagatgaatatatatatatatatatctgtatagacacacatataatatatatagatatataatccctatatatcttgaatctacaaatatctttatatgtatataatttgaatatatacatgtatgtatatacagatgtgtgtgtatatatatatatacatacacatatacataaattttcagctatttctgttcccctgaactaatttgagattagacccaaacatgcttttaaatgtctcatgccaaggcactgaattaagacttcttaatgttgaaatattttaagtgatttcatattaaattttctatatactgaaa

SEQ ID NO: 31380 - DNA, 671 bp, Homo sapiens
ggcctgcggtgcatcaagtacctgctgcttggcttcaacctgctcttctggctggctggatcggccgtcattgcttttggactatggtttcggttcggaggtgccataaaggagttatcatcagaggacaagtccccagagtatttctatgtggggctgtatgttctggttggagccggggccctgatgatggccgtggggttcttcgggtgctgcggagccatgcgggagtcgcaatgtgtgcttggatcattttttacctgcctcctggtgatatttgctgctgaagtaaccactggagtatttgcttttataggcaagggggtagctatccgacatgttcagaccatgtatgaagaggcttacaatgattaccttaaagacaggggaaaaggcaatgggacactcatcaccttccactcaacatttcagtgctgtggaaaagaaagctccgaacaggtccaacctacatgcccaaaggagcttctaggacacaagatctttggcatgatattcagcatggtcctctgctgtgcgatacgaaactcacgagatgtgatatgaagctacttctacatgaaaattgcaatctaaagctttcataccaaatgtcacaggagctgtctcccagctcatttttaacactgaaatgacattaggatctaaaataa

SEQ ID NO: 31381 - DNA, 6035 bp, Homo sapiens
ctgcagcctccgcagaggcgattggctgaagctaccggccgcgtggggcgggactcggttgccagggagcggcgcgggagccctgaggggactgcggcggctgcgcggaggagcgaggcacttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagtagtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttgcggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaacatattatttttcattatttgggggatatttcagttccagagcagcagtatcatgttttctttgttggtgctgtctatagttcatcatggtttacgtgtgttttcgttatagctgttgccagattctaaagggcttgatattcaaaaaaccacagatgctttcagtccagtatatcctagaaatatagagctctactttgtgcaatgcactggggatacagtggcgatactgtccttgtcttcaaggagttcggagtcctagtataggagacatacataggagaagataattttcacactgcagtggttgtagtaatagaatgggagtccaaaggggagttccggagaggtcaggggtgacttcctggaggagatgcccaagcttggaggctggataggctttgttgaaagatggtacacaagagtgtgaaacaaaattgtgtgtgcagggagcttaaaatacaaggctggggaaagaagttggagaagcaggaaagcccaggccctctagtgtcttacggaacatcctgtggaggtgagagctgacttgtaggtggaagcagctctttggaggtttgatttggaaggtgaactgagaagaaggtggtgatgcaagccggccgtgctgaagccaggatgaattggtgtgactgggcttcagttaggctggcatagcagttgagagagcttagcagtgggcagcagggcactgttgggggcggtggtgagcggtggattctggctgtttggaggcaggacagtggtggaattcgatcattgattggacgtgggacagagaagggagaagagaagactcatctaggatgagtcccaggtttctggctcagtcaactggggaaacaaagtcacagagctagggagtagttagagaacacatctgggggtgtgactcatggtcagttttgggctcgtcagttttgagatgcccaaatatcatgcagatctgtcccacctgaaaatggagaagacacgggaaaggagaggagtaaaaactaactccttttcacaaagtggaagttaccagaatgtgatttcagaggccccgggggatttatcatgtgactactgacccatcccacctcttgcccctgcctgttgcacagtgggcaagaatgtttgtgacctttcactaccaccacctcccccgagcatggtccccccagttttcaatatgaaccatcctgtgggtaccctgtcacaggctggccctgaggtgagcaatatttggactgtgatgttggttgttctccactctttctacaggacagaacagggcctctagagtgggaaatggctttgggaaatatgccaagcagtagccttgttcttcaacttgcccaagaggataattctccacacccttcctgtactcagtcctcagtttgcctggtgagagagcagcctcctcccgtgtgctctgccagctggacccagactggccatattaccagtgagaccaaaaagatggaggtggggaggtagctctgaggtctgggaaaccattccagctcctgccagttttaacttgtgtttaattcctggcacagttgtcctggaaatgcctttttctcttgcctgggaaccactagaaggggatgttgtctgtgttggccagggccatgcaaattcaacatcttgtttctgcccttcccccgtgtagctgaggctaggtgttggcattacccagtgcttgttcttcagagagcaaaagcactgctcgtcatgtctgaaatttagtgagtgagctcacccactaggctggtgtttcctgcccgtggctgcacattggaagcaccggggcactttgagaactacagatgcctgggtcccagagcatctaaggtgctctagggtgtgtccaggacacagccctggttgaggaccactgctatattgtatggcctcttttaaaaaagttaattttacttggaaatgatttcaaagctacagaaaagttgcaagaataaaaactgtacaaatgaggctcaaatatcctttgcccagatacacctattaacatttcgtcccattctatctgtcatgtgtgttctcaaatgtgtgtgcgttctctctcccttgcgccaaccccctgtctctccctctccctccctcctgctgcctccacacctgtcatggccttttacccctaatacctcagtgggtacttaccaagaagaagatactctctgacgactgcagtacagttgtcaaattccgtccatctaacactgatagaatacctcaccactcatattcccattggccgcatcgtgtcctctatagcacctttccctctgcggtgctggatctggtctggatcaggtaatcagttgagttgtcatgtctccttggtcttctttaatctggatcatttccatagctttgtctgtgatgataggaacagtttgtaaggatacagttcgttttaggtggtgctgcttatctgtgtttgtctgcgatttcctcgtgattagatttggttttgcattccaggtggctgaaccactacctgcgtcacgcggcctctcagggcatcgcatctcgaggcacacaatgcccatctgccccacagtggggatgttcgttttgatcatctagtccaaggaggaggaaatgtgaacaggaaggttttaatataagtaattgttaactgtgtagaaggtagttaactactaaaagggataaaaaagagctctaaagcagcttagcagagaacagccatcacccctagggctaagggaagagaaaacagagaaggaacgtggaaactcagaggaggttccccaaggtggagagacctccgaggggtggctgtggttgcctgggatatgctgcctgtcccatgctggagaatcaacttactggaggtgcccccccgccaagccacaggagcagagagctgtcacggtggggaatgctgctgggacccgtgcaggacgaaaggagacagaagaaaaaggccatcttcctcctctagccttgttagccccttcagagcccactgtgggtcaggctggcaaagggtaaaggagttttcagagccccctcttcagtgtgacaaggaagggcaaggtcagggaaatttggagttaagaggcaataaatgagtacctggcacacctagtcgaggtgtgtccactttctccatagcatggttactgtttttttcttttcaactaataagaaatctctggagacacactgtctccatgtacataccctgttcctcatgagactcttcccccattccccgaccaggttcagcaaatgttgctgattctggcctgattcaatctttatgatgactgccaagcgacgtttctgcagcccagcactccttcctcatttgccagtcatccctcccttctccttcatttattttcatatatccactatggattcccattttttcaaaagtcgacttcatcattgacctttggggatgggggaagagttcctcagatagttcccgacttggccagcgagagccccttcgagtgcctcctatatcccagcatttttggaagcactcccctaatttctgatctaacaagatgttccaggcccctgggcaccagccatggatcagtgtttgtcccaggagccctggtccctggcactaggtgtgcttattgcagctggggtgtctttgcttcttgtcctatagatgattgacagagcttgtcttactgccttttttaagtgtatttttttaaacaaaagtaattggtgctttaaaaaatgtgaacaatacagacatctgtaaagaagtacccacagggaagcaagttcagcagttcagcaatggcatgtgtctttgcagactacatacacagaaacagacttggtattgggttttggtttttgctttttgctaataggaattttatcctacaagatcctctttctgtcttcacaacatagtctgatgctccttccatgtctaactgtaggatttgtcattccattgtgttagctgtgtgggtacattagtaccatgattaaccaaggtgtataaagggcaggcctgcaggctgcctccagtgcctccactactcgccacagtgatcatctctatacacacactgcagtcatttacaatttttaaaatgaaaacaatttttattgagatgcaattcacatggcataaaattaacgattttaaagtaaa

SEQ ID NO: 31382 - DNA, 1647 bp, Homo sapiens
acttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagtagtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttgcggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagccccc

SEQ ID NO: 31383 - DNA, 1459 bp, Homo sapiens
atgtgggagcctatgtcttcatcacttatgatgactatgaccacttctttgaagatgtgtacacgctcatccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagtagtgaagaagctacaagaaatcatgatgcatgtgatctgggccgcactggcatttgcagctattcagcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttgcggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaac

SEQ ID NO: 31384 - DNA, 1530 bp, Homo sapiens
acttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagtagtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttgcggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagccccc

SEQ ID NO: 31385 - DNA, 1849 bp, Homo sapiens
agttttaagtttcgcccaatgaaaaaacaaaaggagagggacagaaggcgggtcggtgacgtaatgcgggttgattggcatgcaggccttggacgtccaggattagccacgcatttcgccaatccagaggcaggggagggacggtgcaggcgcagagtattgggtttggctggcctcgatttaaagagacagaagctgtcggggtcctggaagacggtccccaataccctccccccaagtccttgggaccacttgggtccccagagctggggagatggtttgtggcggctttgcctgctccaagaatgcgctttgcgctctcaacgtggtctacatgctggtgagcttgttgctcattggagtggctgcttggggcaagggcctgggtctggtgtccagcatccacatcatcggcggagtcattgctgtgggagtcttccttctccttattgcagtggctggactggtgggtgctgtcaaccaccaccaagtcctgctgttcttttacatgatcatccttggtttggtcttcatcttccaatttgtaatctcttgctcatgtctggctattaaccgaagcaaacagacagatgtcatcaatgcttcttggtgggtcatgagcaacaagactcgggatgaactggaaagaagttttgattgttgtggcttattcaacctcacaaccctgtatcaacaagattatgatttctgcactgcaatctgcaagagccagagccccacatgccagatgtgtggagaaaagtttcttaagcattcagacgaagccctgaaaatcctagggggtgttggactcttctttagctttacagagatccttggtgtttggctagcaatgagatttcggaatcagaaggatcctagagccaaccccagtgcctttctatgagactttggatccttctgacttttcttctgctctctctaagctttctcttcctcccttagggaatatctagggtctgtaaccgttttggtttgagaaaaaggaaaggccccttgtcacatcctctaaaattgatggaatagcaagactttatgccttgacatattttagtgggagccagactataaggaataaaaggaaaaactttcttcctctctctccaagaggatatgggaagcttctgtgagtgcataggatgggggctggagtcattcttagctgtttcccttcctctgtccatatactggatcacctcaacataccctggtgtggctctaagggtaaatcagggatagggccaaggagaaaacaaccaagaactctttcctgtaataagcaggatccagtttgagaaagtttagcgaatataaaagtaaaagccatttaaaaatctatattctttttttttttttgacacagagtcttgctctgttgcccaggctggagtgcaatggcatgatctcggctcaccgcaacctctgcctcccgggttcaagcgatcctcctgcctcagtctcccaagtagctgggattacaggtgtgcaccaccacgcctgactaattttgtatttttagtagagacagggtttcaccatgttagtcaggctggtctcgaactcctgacctcaggtgatccacccgcgttggcctcccaacgtgctgggattataggcgtgagccaccacgccccgcctaaaatccatattcaaagaagcaatttcagttcctttctaagctttgtcagtcaaggggctccactgacttcctaggccctgtaatttaaccagtctttaaggttttgcaggaaagtcccttcttccaagtggtttttccaaatcgcacaatggcaaagccaaacagaggaagaaacattaaaaaaaaaaa

SEQ ID NO: 31386 - DNA, 1318 bp, Homo sapiens
agggcgatgttgacagacagacagaggggcggatgcagcctacctcctgggcagtgagctgcggtctgaggcccctgcccagctggaaaccacagggaggggaagggaggggaggagaggagaggagaggaaccgtcatggggccttggagtcgagtcagggttgccaaatgccagatgctggtcacctgcttctttatcttgctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcagggggcttcctgtgcttctccctggcgttctgcgcacaggtgcaggtggtgttctggagactccacagccccacccaggtggaggacgccatgctggacacctacgacctggtatatgagcaggcgatgaaaggtacgtcccacgtccggcggcaggagctggcggccatccaggacgtgtttctgtgctgtgggaagaagtctcctttcagccgtctggggagcacagaggctgacctgtgtcagggagaggaggcggcgagagaggactgccttcagggcatccggagcttcctgaggacacaccagcaggtcgcctccagcctgaccagcatcggcctggccctcacggtgtccgccttgctcttcagctccttcctgtggtttgccatccgctgtggctgcagcttggaccgcaagggcaaatacaccctgaccccacgagcatgtggccgccagccccaggagcccagcctcttgagatgctcccagggtggacccacacattgtctccactccgaagcagttgctattggtccaagaggatgctcgggtagtcttcggtggctgcaggagagcgatgctgcgcctctgcccctctcctgccacctggctgcccacagagctctccagggcagaagtcgcggtgggctcagtgggtgccctgagcggggtctctcagactgacgtcaggccttggtgggctgcactctcacctggaggctccggggaagcatctgcctccaggaccattcaggctgttgacaagtcaactcctcatggctgtaggactgaggttcccaagtccttgtccctggtcctgtggtccctccaccttcaaaccagcaatggtgcattgagcaaattgtggtcaaatatacatcacatcaaatttaccatcttaa

SEQ ID NO: 31387 - DNA, 999 bp, Homo sapiens
atggggccttggagtcgagtcagggttgccaaatgccagatgctggtcacctgcttctttatcttgctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcagggggcttcctgtgcttctccctggcgttctgcgcacaggtgcaggtggtgttctggagactccacagccccacccaggtggaggacgccatgctggacacctacgacctggtatatgagcaggcgatgaaaggtacgtcccacgtccggcggcaggagctggcggccatccaggacgtgtttctgtgctgtgggaagaagtctcctttcagccgtctggggagcacagaggctgacctgtgtcagggagaggaggcggcgagagaggactgccttcagggcatccggagcttcctgaggacacaccagcaggtcgcctccagcctgaccagcatcggcctggccctcacggtgtccgccttgctcttcagctccttcctgtggtttgccatccgctgtggctgcagcttggaccgcaagggcaaatacaccctgaccccacgctctccagggcagaagtcgcggtgggctcagtgggtgccctgagcggggtctctcagactgacgtcaggccttggtgggctgcactctcacctggaggctccggggaagcatctgcctccaggaccattcaggctgttgacaagtcaactcctcatggctgtaggactgaggttcccaagtccttgtccctggtcctgtggtccctccaccttcaaaccagcaatggtgcattgagcaaattgtggtcaaatatacatcacatcaaatttaccatcttaa

SEQ ID NO: 31388 - DNA, 1332 bp, Homo sapiens
aaagctgcggcggcggttcgcgtttctcgtgtccgcttgactgacagctgcgcggcgggagcgggcggcgcgagcgggaggcggcggcgcagagcttggggcttccttggtcgcacccaccacctgcctgcccactggtcagccttcagggaccctgagcaccgcctggtctctttcctgtggccagcccagctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctagctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaaccttg

SEQ ID NO: 31389 - DNA, 1423 bp, Homo sapiens
gtctgagcagggccgtaaagctgcggcggcggttcgcgtttctcgtgtccgcttgactgacagctgcgcggcgggagcgggcggcgcgagcgggaggcggcggcgcagagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctagctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaa

SEQ ID NO: 31390 - DNA, 1462 bp, Homo sapiens
actgccccagcctcaggctctgtgcatctcccccgagcccccaccacatatgtgcggaggcccctgggggcccaggcctgtcctcagtcccgactgggctctacctgaggaccctggggagcctgggcctggccctcctcagagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctagctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaaccttg

SEQ ID NO: 31391 - DNA, 1426 bp, Homo sapiens
tggacgcacatcctgctctgggcagaagggcaggacaggggccctgagtaacggtggcctggggtcagagccaggttcagctgcgaggctgctggtggctgtggagagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctagctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaaccttg

SEQ ID NO: 31392 - DNA, 1430 bp, Homo sapiens
cgtgcggccagggtcccgtggccggaggtgtccgaccgggagcggctggagccggacgcgagcggggcgcgcgagttcgagcccagagccgacacgcagcaacaagtgggagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctagctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaaccttg

SEQ ID NO: 31393 - DNA, 1025 bp, Homo sapiens
gagcagggccgtaaagctgcggcggcggttcgcgtttctcgtgtccgcttgactgacagctgcgcggcgggagcgggcggcgcgagcgggaggcggcggcgcagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctagctcaggtggcttcagggcctcc

SEQ ID NO: 31394 - DNA, 1339 bp, Homo sapiens
agaggcgtggggtaggctgcagggcacagctgggggcctctgtccccatctccggctgtgggaggtgtgtgcgcatccggcgtgatgacacccaggagtgcaggcacatctgcgcacggggccgaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctagctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaa

SEQ ID NO: 31395 - DNA, 1031 bp, Homo sapiens
aggggccctgagtaacggtggcctggggtcagagccaggttcagctgcgaggctgctggtggctgtggagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctagctcaggtggcttcagggcctccggaccccccctgggaggggtggccacgtgctggctgcgga

SEQ ID NO: 31396 - DNA, 834 bp, Homo sapiens
aggttcagctgcgaggctgctggtggctgtggagagcttggggcttccttggtcgcacccaccacctgcctgcccactggtcagccttcagggaccctgagcaccgcctggtctctttcctgtggccagcccagctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggaga

SEQ ID NO: 31397 - DNA, 860 bp, Homo sapiens
tcccgggtcccggctctgctggctgctcgccgtcccgagctcccgacgctcagacgcgcctctgagcacggggagaggggacccgggagggaggtcggggagggagtcgtggaagaggtgctttttgagctgaacctggaagaccccggcacaggggatccctgggcagactcccggaggctgcactggcaggaccccctgaaggcctcagctctggcttgccctggagctcagggcctacggacgacgagggacgaggagcccgtgtctctcggatggagtgcgggggggctggcaccagcacccttcttgctgtgcccctggggtggggagcttggggcttccttggtcgcacccaccacctgcctgcccactggtcagccttcagggaccctgagcaccgcctggtctctttcctgtggccagcccagctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgg

SEQ ID NO: 31398 - DNA, 968 bp, Homo sapiens
cggggtcgggggcgcgggggccgcagcgcgcgggccgggcagatgtttgggttccgccgccggggtccgagcggatccgcgcgacccgctgccaccgcgggggccagagcgggagcaggagcggggccggagcaggcgccggccggcgggatggggcgttccggggcggcgggtgcggggcgctgagcggcggccccggcacacccgggcgcgatgcgccgctccagcacggacgagtccacgtaccggcgcagcccctctccggagggcaaggagccggacttcgcgcgcggcggccccttccggcgctacagcagcctatacgggcgcgcgggcggcggggacgccgggggctccttcttcggcctgcacgcgaaccccggccccaaggcggcccaggcgcgctacacgtcgcccaagggcaacaagtacgtggttttctacctggacctctccttcatcttcctcctagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgta

SEQ ID NO: 31399 - DNA, 818 bp, Homo sapiens
cgggaatggggtcggggtgcgccctcccgggtcccggctctgctggctgctcgccgtcccgagctcccgacgctcagacgcgcctctgagcacggggagaggggacccgggagggaggtcggggagggagtcgtggaagaggtgctttttgagctgaacctggaagaccccggcacaggggatccctgggcagactcccggaggctgcactggcaggaccccctgaaggcctcagctctggcttgccctggagctcagggcctacggacgacgagggacgaggagcccgtgtctctcggatggagtgcgggggggctggcaccagcacccttcttgctgtgcccctggggtgggggtgaggaaatggggggtcggtgtgcagtgagaggcaaagaaggctccttggaggtgcgagggctccactctgcccatctttccttttgcagagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcact

SEQ ID NO: 31400 - DNA, 3365 bp, Homo sapiens
gcgaacgggcgggcgagcaagcgagcggcgtctccaccagcatctgccgcggccgcctttgcccgaagcccggggacgaaccgacggaccgaccgcctggcgcacggacgcgggcgctcgctttgtgttcggggctagcgtcggcgaggcttgagcttgcagcgcgcggcttccctgctttctcgcggccaccccggctccggcggcctcggcgcgcgaggggctggaggtgcgggagccgctctccgccggtcggtccccgcgcggctgagcccaggccgccagcgccgcggccccgtgcggtgtccctgagctcctgctccccgccgggctgctccgagcaacggtgcttcggagctccaaactcgggctgccggggcaagtgtcttcatgaacccagaggatgtccgggaagcactacaagggtcctgaagtcagttgttgcatcaaatacttcatatttggcttcaatgtcatattttggtttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcgttccattctcctgctgcactaaagatcccgcagaagatgtcatcaacactcagtgtggctatgatgccaggcaaaaaccagaagttgaccagcagattgtaatctacacgaaaggctgtgtgccccagtttgagaagtggttgcaggacaatttaaccatcgttgctggtattttcataggcattgcattgctgcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaaaaaaaaataaccagtatgaaagtcgttgcgccgtgaatctctactgtagccatgaatttatggacagttagatgcttaccaaaaaagaaaaaaagggagggtaggggacccagatgtacttgaatgtgcagaaaatacattcttgtcctcatcttccgtaattggagggctgggagaggcagctttgctcttcaccacaccttggacggaccaccttctttctgttccatggcctgaaggagtgcatctcctcaaagactcagcccctcacctgggagggcagtggtttgtgggcatccctccatgtacattttaggaaacacttgcaactctcatctgaagaagaaaacaactcatctttgggttcagattttgtgatggtattcagcaagtcacttgggcgagcacacttggtctatcctggaaagtctccttataagagaagttgtgtatttcatgtgcaccgagcaagggcattggaagacgtcatgaggctgtattttagcaggactgatcgtttttctaagtagacctgagctttgtttatcagtgaaattcaaggagaaaatgaggttaatgaagaggtatcagttaaatatccccttcttctcaccctgccaaaattagcagttggatttttggaaactctggaatattctgggtcattttgttttgtatgtttgttgtttttcgtcttccaaaggtgaaagctatgatacagttccacttaaattttagtgttttcttactcagctcaagcattaatttttgattaagtcttaatctgcatgacctgtgaatctgaatccatcatctccctttcctgccagcttttctacaaacattgaaatatgttatttggtcagcacttatttcctaggttcacagccttgggaggttgtggcatgtcctcccagtctggctgggaagagaccagctgtaccatccaaatgcttccctggtcttgatgatctcttccagagtcgatctgagtggccttttctgcaccctccccttctttctctttgaatggaattaaacccaatttggaaacaacattgacccagtcaaaagcttctaatggtttctttttcttcctccagttttagtttgcttttattaaaaaaagaaaatagtgcatggccatagctccttcagttctcttattgcagactaaccatcaggatggtatcaaagcacaaatactttggaggggaatgcgttgaactggggcaagtactctgtaacacaaagtgggaaaccacttcctggtgctgccgctcctgcccccactttaggtgggagggacgagttttgccctctagattttaatccagctggtgtccaccggatgttgccctcctggggagcagatatcagtctgtggaactctgggaaaaccacaggcacatttttcggtgcggacagatttgccagcacataactgggcagccagctagaatactttgtggaaattaagcgaggttttccatttcagccccatggtgcatggtggtggccgatgaatgtgtcagtctgctcagagaaaggacaaaaaggaaattattttcaaaactgtgttcactgtttgggtgtgtgtatggctctgcatgtgtgtgtttttgtctctgtataggtagaggtattcacatcttactccgactgtaaggttgtcttacttcatctctgcccccaccacagttgccattttgtaatgtccttccaacatggagaagacacgagctctctccagttggcatcatttgtcttttttgttgattgcctcattctccagtgaactccatctggccaattgattcagaatcaggcaagatccctgccctttggcacatccactgaaaggccaaacagcaagtccgagtgagttttaaatattaattaatcaccctttattttttacacttgagagtgattgtaataaaggctgtcattaataaacttggttctacctta

SEQ ID NO: 31401 - DNA, 1191 bp, Homo sapiens
gttgccgcggctggtctgtgccatgctcagcgtgtatcttcttgcaccatctcgggctttgtgtaggatgcagatgccgtggtatatggtcctgtaattgcacgtaaataacgtttcctgcacgctctcctcttcagctggaaagcgctcccttttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcgttccattctcctgctgcactaaagatcccgcagaagatgtcatcaacactcagtgtggctatgatgccaggcaaaaaccagaagttgaccagcagattgtaatctacacgaaaggctgtgtgccccagtttgagaagtggttgcaggacaatttaaccatcgttgctggtattttcataggcattgcattgctgcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaaaaaaaaataaccagtatgaaagtcgttgcgccgtgaatctctactgtagccatgaatttatggacagttagatgcttaccaaaaaagaaaaaaagggagggtaggggacccagatgtacttgaatgtgcag

SEQ ID NO: 31402 - DNA, 1270 bp, Homo sapiens
agtatggcatcgaggagaatggagaccaaacctgtgataacctgtctcaaaaccctcctcatcatctactccttcgtcttctggaaagaaaaggctgcaggattttgtggcagacaggatgtggctatggctttgatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctcccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttt

SEQ ID NO: 31403 - DNA, 1909 bp, Homo sapiens
gtaggagccccgcgcggtgcgcgctcacgcacgcgcacggcctcgcctgcgcgctcacgaggcctctcgcggcacgcgcccccgccccgcgccgccccgccccgccccgcctcttccccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctggatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctcccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcggttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaagtaatgcctctgtctagcatgccaacaagaatgcattgatattgtgaacatttgtgatatatgtattaataaatagagcaattac

SEQ ID NO: 31404 - DNA, 1210 bp, Homo sapiens
gtagtatggcatcgaggagaatggagaccaaacctgtgataacctgtctcaaaaccctcctcatcatctactccttcgtcttctggccctatttttgctttgaaactggagcacagtgctgtatgaggtaccgagaatcagctagatggcaaaccggactgtttgcaatggtcaaggaagaagcagagatttattgaggatcaaaaatattcctaatgcacccggacatttccttatcgctggcgttggtggttcttcaagtcagggaaggtctatagaagaggagggaaaaacacacctaggaatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctcccccttaccccacaacgtgcaactgacactcccacccagtctctgctccacctttcagcccacgtcacgtgtagtgtccattttgtgaagccctgttgtgccacagagtgtagc

SEQ ID NO: 31405 - DNA, 1224 bp, Homo sapiens
agtatggcatcgaggagaatggagaccaaacctgtgataacctgtctcaaaaccctcctcatcatctactccttcgtcttctggccttgcctactgaagagaataagaagctgggtttctcctcatttacataacaagtaatatggtatggaagatggaaccgaagatttgaggtcagaagacctaagttctatggcttttctacaacctagatgatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctcccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgact

SEQ ID NO: 31406 - DNA, 1227 bp, Homo sapiens
gtgccattctcttgcctgatccagtgccattcccttcacttgatatctgtttactttagaggaggcagtttttgagaaaggatcataaatatcctggcccagtgccccaggagctatgacaagcaaaggaacatacttgcctggagatagcctttgcgatatttaaatgtccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttac

SEQ ID NO: 31407 - DNA, 1516 bp, Homo sapiens
gctttgtagtagagatagctgttcaggaggaggaaatgtgaattctgagagcgtgatcatttaggagagatttccattcctggaacgatatcactaccacatgcacgagtgcaattgaagggaaacctggtggggaaacagttttaacattctttcagaaaaagaatcactacctagtggaaaatgttgtgcaagcctcttcatgtttcttccctccagaaaacaactaaacagatggaagaactggttcacaaacatcccaactctctcctgccaaggtccagtgggcttgttgctccagacctcatgccttctggacccagacatctctgcaatctcggaactggaatacaccacttcttgtcaaggtactagcaagttgactatgaactgctgggagataagaccatctgatttatccgtgtacatacagcagctagcacaccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttggtgcttttcta

SEQ ID NO: 31408 - DNA, 1168 bp, Homo sapiens
gtgtgggttaatagcctttgcgatatttaaatgtgtgggttaatttttttatccagtttaataactttttattcctccctctacttctttgctttctctttctgctctgaagccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgttta

SEQ ID NO: 31409 - DNA, 4323 bp, Homo sapiens
ctgtttccgctggcggcggcggcggcggcggtgccggagcgcgagcagagcggagacccccaggtcctgcgggcgcggaatatcctggaaccttcttttgtttgtcagcagccaaggtgtttccaggaagttcagagagaacagaatttaagaagtgcaacatggccaggggctgcctctgctgcttgaagtacatgatgttcctcttcaatttgatattctggctctgtggctgtgggctgctgggagtgggcatctggctctccgtgtcccaaggcaactttgccaccttctcccccagcttcccttcgttgtctgcagccaacctggtcattgccataggcaccattgtcatggtgacgggcttcctcggctgcctgggggccatcaaggaaaacaagtgcctcctcctcagctttttcatcgtcctgttggtcatcctcctagcagagctgatcttactcatcctcttctttgtctacatggacaaggtgaacgagaacgccaagaaggacctgaaggaaggcctgctgctgtaccacaccgagaacaacgtggggctgaagaacgcctggaacatcatccaggctgagatgcgatgctgtggtgtcactgactacacagactggtacccagtgctgggggagaacacggttcccgaccgctgctgcatggagaactcccagggctgcgggcgcaacgccaccacgcctttgtggagaacgggctgctatgaaaaggtgaagatgtggttcgatgacaataagcacgtgctgggcacggtggggatgtgcatcctcatcatgcagatcctgggcatggccttctccatgaccctcttccagcacatccaccggactggtaagaagtacgacgcatgagcgggctggccgggagtgcccaccccgccctgctgccctgtggagggaagaggattgagctttgtgtcacctgcctgcgctctccagatatgacccctgcacccaccccccacagcctgccctaccccacctaccctgcctcagcctcggacttctcagtgggtggagtgccagggaggaggaggcacacggagacctggggctcggggcccctggattcctgcatctgcatatgcgtatttgccaaagacgacagggtgggctggggtgcgctccggaggaacccccggcactgatgggcttctgcccctgcccttcctcacactgacactttgtccccacatggggtggggagcagagtgcccgccccgtggagataccgccccagcgggggctgcgacatccatggccaccatggggcacctggcggggcgggggtctgccggcctctgggcaaggcccctggagcatctcgcccaggctttttataccttacaatgtaacttttttattttattttactctatgattattcaggaatattatctctcagataagtttagggttagatttctgatttgtaactttttactgtgttgatttctttaatggtttgactttttttccctgagggtgagggatgggtgggaagagaggacatctgtccagtctcaatcaggacagaccaccgtgcgacacccaggaggctctcggatggggcgcgcctgcgccctcagaacgtgtgggaaggagggggcgtggacaggacacgggaccttgccaggcctggtgtctgaggacaggagcctgggagaggcgggtggagcgtgaagcaggctggaggtgcccctgcacgggaggtggcgtttgctaaccaatcgagctggaaatgccagggcaggggggccccacggtgctgtggcagagctagaggggtccttagacttttcactgatgagcagttgttggttttttctttctcccttcctcccgctctctgctggcacgcgaggcttccccttccaccccatgtgggtattcccacaacaggttctgcacaccccagttatttcacagacattcctgctagaaactgtcagacaaatacctctctagttcggatgctgctcactttcccccttgcttctggaaggggaagcagtccttaggttttgctgtgctgggacagtggcaggggacccacaggggtgaggacccacggtcctccccgccagccttgctcagctgtgggttgccctgctgggaaggagggaatcacgtccacctgggtcccaagatcttcgcctccttccctggggccacggacatcagcagtgggttgggtggcgattatatcatctgtgatcccaaggagaagaaatacagaaaacccaagagaggtcagactggctcttgttaccggagccacgggaagaaagcagccggagtcacgcacgtgcagagctgggcatgggagagaaacgggctggggagtgaggccaggagtgggattcagctgcagcagggcgccccctccaaactgcagctggtctggcttactgttttgccgttcaaaaaggtcgcgaatccgtgggactgagcacggggacctcacccgctagccagcgtctgctgcacttgatcaggtggggccttggtgggcggctgcctttcctatacagtttgtcttgtcaccctggtttcccactggggccaggtctcttctccagcctccacctgcctgtctgatccaagagctgagacacggccacccagcaccagtcactcctctgttcaccttaagtaacacacaaatcgggaacaggaggacagaaccgttggcattatcaggattcgtgttttgtgggggtgggagtggagagtagggtggtcttgtgagttgtgcagggtgaagaccgcttccctgagacaggggcagtggtgctgatggaatgtgggggaggcccacatttgagcaaagctgccctgcccttgtcccctggcctggcttcctggtaaggagtttcagccgcctccgcaggaacccccaaagtgcagattccggagcagacacatccgggcggagagactcagcagacaagtgctgcagttgcacggtgggacccggggcctcgtgcgttttttgctgtgggtggggtgggtgggttggtttatgcctatcaatgcaatttttaatttttgttaatatcaacagcaaaagcctagtgcattgggagatgtgcaacctccctgaaaatcttttctgtttctggagtacttcaggggtggcctctggccccagagcctttgccacagtgctcccaccagcccccacctcatccgtctgtttgcagagcctcatctacaggtccccacgctgccttctttactcactctgcgcttggccgttttgttatttggcttagtctacattgggcggaagtctgtgtgcacagagtgggtgttccttcgagccccttccactcagagggccacacccagcgatgccagtgaaggtggcacagcctctcttcagtttctcctgactgtgatctcactggggtagaattcccctgagagaattccctcactcacggctccctttgccagagtcagttcaatcaggtctgatgtgagcaatttacacacttgtctcagaaagtccctcagggtttgtagaggactgcaggggggcatccgctgcagactcagcctttctctgcagccatcctgcagtgggggtgagcgggcacaggctgagaactgctcttgggtggtggaagcaggtgtcacggtgcaagtctccccctgcacccctcccccagcttgagccgtgtcacccccctctccctccagcatgggcctgtgtctcaggctctctggaaggtggccctgccccggaccctcttgcaggtgtcctggtttgacttggaactagatggccatctttccaggctttggtggcccaagagcagtctgggtggatggaagtggctgtcccctcctctccagcccctgcccacccactggtggaggtgctaactagcagggacgtggcataggatgggagctgggcgtgaggtgcttggggtccattctttgtccctcagcttctcagagtccggccagcccttgtgttcccgtgccccacactttcctcctccccactgcagtgagtcaatagtccagggtggggcctggcctccctgccctgattggggactcaggaggtgaggcctggggggcttcctgccccctccttgcccacctgcctgcccccgggcagcacgggagggagagcagggtgagcacgcttgttggtttcagatgcactttctgcttgcattgccgtatctgtgcgttccttcatcctggtcctggctttatggaacaccatgtttttagcatgtttttaaataaaaacggataaagtgtcaaaagc

SEQ ID NO: 31410 - DNA, 4284 bp, Homo sapiens
attcccgggcaggccccgccccctgtttccgctggcggcggcggcggcggcggtgccggagcgcgagcagagcggagacccccaggtcctgcgggcgcgaatttaagaagtgcaacatggccaggggctgcctctgctgcttgaagtacatgatgttcctcttcaatttgatattctggctctgtggctgtgggctgctgggagtgggcatctggctctccgtgtcccaaggcaactttgccaccttctcccccagcttcccttcgttgtctgcagccaacctggtcattgccataggcaccattgtcatggtgacgggcttcctcggctgcctgggggccatcaaggaaaacaagtgcctcctcctcagctttttcatcgtcctgttggtcatcctcctagcagagctgatcttactcatcctcttctttgtctacatggacaaggtgaacgagaacgccaagaaggacctgaaggaaggcctgctgctgtaccacaccgagaacaacgtggggctgaagaacgcctggaacatcatccaggctgagatgcgatgctgtggtgtcactgactacacagactggtacccagtgctgggggagaacacggttcccgaccgctgctgcatggagaactcccagggctgcgggcgcaacgccaccacgcctttgtggagaacgggctgctatgaaaaggtgaagatgtggttcgatgacaataagcacgtgctgggcacggtggggatgtgcatcctcatcatgcagatcctgggcatggccttctccatgaccctcttccagcacatccaccggactggtaagaagtacgacgcatgagcgggctggccgggagtgcccaccccgccctgctgccctgtggagggaagaggattgagctttgtgtcacctgcctgcgctctccagatatgacccctgcacccaccccccacagcctgccctaccccacctaccctgcctcagcctcggacttctcagtgggtggagtgccagggaggaggaggcacacggagacctggggctcggggcccctggattcctgcatctgcatatgcgtatttgccaaagacgacagggtgggctggggtgcgctccggaggaacccccggcactgatgggcttctgcccctgcccttcctcacactgacactttgtccccacatggggtggggagcagagtgcccgccccgtggagataccgccccagcgggggctgcgacatccatggccaccatggggcacctggcggggcgggggtctgccggcctctgggcaaggcccctggagcatctcgcccaggctttttataccttacaatgtaacttttttattttattttactctatgattattcaggaatattatctctcagataagtttagggttagatttctgatttgtaactttttactgtgttgatttctttaatggtttgactttttttccctgagggtgagggatgggtgggaagagaggacatctgtccagtctcaatcaggacagaccaccgtgcgacacccaggaggctctcggatggggcgcgcctgcgccctcagaacgtgtgggaaggagggggcgtggacaggacacgggaccttgccaggcctggtgtctgaggacaggagcctgggagaggcgggtggagcgtgaagcaggctggaggtgcccctgcacgggaggtggcgtttgctaaccaatcgagctggaaatgccagggcaggggggccccacggtgctgtggcagagctagaggggtccttagacttttcactgatgagcagttgttggttttttctttctcccttcctcccgctctctgctggcacgcgaggcttccccttccaccccatgtgggtattcccacaacaggttctgcacaccccagttatttcacagacattcctgctagaaactgtcagacaaatacctctctagttcggatgctgctcactttcccccttgcttctggaaggggaagcagtccttaggttttgctgtgctgggacagtggcaggggacccacaggggtgaggacccacggtcctccccgccagccttgctcagctgtgggttgccctgctgggaaggagggaatcacgtccacctgggtcccaagatcttcgcctccttccctggggccacggacatcagcagtgggttgggtggcgattatatcatctgtgatcccaaggagaagaaatacagaaaacccaagagaggtcagactggctcttgttaccggagccacgggaagaaagcagccggagtcacgcacgtgcagagctgggcatgggagagaaacgggctggggagtgaggccaggagtgggattcagctgcagcagggcgccccctccaaactgcagctggtctggcttactgttttgccgttcaaaaaggtcgcgaatccgtgggactgagcacggggacctcacccgctagccagcgtctgctgcacttgatcaggtggggccttggtgggcggctgcctttcctatacagtttgtcttgtcaccctggtttcccactggggccaggtctcttctccagcctccacctgcctgtctgatccaagagctgagacacggccacccagcaccagtcactcctctgttcaccttaagtaacacacaaatcgggaacaggaggacagaaccgttggcattatcaggattcgtgttttgtgggggtgggagtggagagtagggtggtcttgtgagttgtgcagggtgaagaccgcttccctgagacaggggcagtggtgctgatggaatgtgggggaggcccacatttgagcaaagctgccctgcccttgtcccctggcctggcttcctggtaaggagtttcagccgcctccgcaggaacccccaaagtgcagattccggagcagacacatccgggcggagagactcagcagacaagtgctgcagttgcacggtgggacccggggcctcgtgcgttttttgctgtgggtggggtgggtgggttggtttatgcctatcaatgcaatttttaatttttgttaatatcaacagcaaaagcctagtgcattgggagatgtgcaacctccctgaaaatcttttctgtttctggagtacttcaggggtggcctctggccccagagcctttgccacagtgctcccaccagcccccacctcatccgtctgtttgcagagcctcatctacaggtccccacgctgccttctttactcactctgcgcttggccgttttgttatttggcttagtctacattgggcggaagtctgtgtgcacagagtgggtgttccttcgagccccttccactcagagggccacacccagcgatgccagtgaaggtggcacagcctctcttcagtttctcctgactgtgatctcactggggtagaattcccctgagagaattccctcactcacggctccctttgccagagtcagttcaatcaggtctgatgtgagcaatttacacacttgtctcagaaagtccctcagggtttgtagaggactgcaggggggcatccgctgcagactcagcctttctctgcagccatcctgcagtgggggtgagcgggcacaggctgagaactgctcttgggtggtggaagcaggtgtcacggtgcaagtctccccctgcacccctcccccagcttgagccgtgtcacccccctctccctccagcatgggcctgtgtctcaggctctctggaaggtggccctgccccggaccctcttgcaggtgtcctggtttgacttggaactagatggccatctttccaggctttggtggcccaagagcagtctgggtggatggaagtggctgtcccctcctctccagcccctgcccacccactggtggaggtgctaactagcagggacgtggcataggatgggagctgggcgtgaggtgcttggggtccattctttgtccctcagcttctcagagtccggccagcccttgtgttcccgtgccccacactttcctcctccccactgcagtgagtcaatagtccagggtggggcctggcctccctgccctgattggggactcaggaggtgaggcctggggggcttcctgccccctccttgcccacctgcctgcccccgggcagcacgggagggagagcagggtgagcacgcttgttggtttcagatgcactttctgcttgcattgccgtatctgtgcgttccttcatcctggtcctggctttatggaacaccatgtttttagcatgtttttaaataaaaacggataaagtgtcaaaagcacagca

SEQ ID NO: 31411 - DNA, 1435 bp, Homo sapiens
atcgacggaagtgcacctgactgagcggaagtaggagctctcagaggctaagaaggtggagaccggagaagctgtgaggttctttagcgtcacctccctcactgggcagcatgggggagaagtcagagaactgtggggttccagaggatctgttaaatggtttgaaggttacagatactcaggaagccgagtgtgctggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatgaagaatacctaatagaactggaaaaaaacatgtcggatgaagagaaacagaaaagaagagaagagagcactagactaaaggaggagggaaatgaacagtttaagaaaggagattatatagaagctgaaagttcttatagtcgagccctcgaaatgtgcccatcctgcttccaaaaggagaggtcgattctattttcaaatagagctgcagcaaggatgaaacaggacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaaagcatcttatctaaaagaaaggctatccagtagagcccagtgctcccttgtccctcttttatgatcagggtgaaatgtacttcctgatgtaatgaacctaatttgatttccattttaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatt

SEQ ID NO: 31412 - DNA, 1432 bp, Homo sapiens
atcgacggaagtgcacctgactgagcggaagtaggagctctcagaggctaagaaggtggagaccggagaagctgtgagctttagcgtcacctccctcactgggcagcatgggggagaagtcagagaactgtggggttccagaggatctgttaaatggtttgaaggttacagatactcaggaagccgagtgtgctggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatgaagaatacctaatagaactggaaaaaaacatgtcggatgaagagaaacagaaaagaagagaagagagcactagactaaaggaggagggaaatgaacagtttaagaaaggagattatatagaagctgaaagttcttatagtcgagccctcgaaatgtgcccatcctgcttccaaaaggagaggtcgattctattttcaaatagagctgcagcaaggatgaaacaggacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaaagcatcttatctaaaagaaaggctatccagtagagcccagtgctcccttgtccctcttttatgatcagggtgaaatgtacttcctgatgtaatgaacctaatttgatttccattttaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatt

SEQ ID NO: 31413 - DNA, 2250 bp, Homo sapiens
actgcgccatttcctgtccaaagctgggcgaatcagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgcacagaacaaactttattcagaatgcacaatggatttagtatcatcagtgacaacgaggtcataagaaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagttgagcgttatgatgaagctgctcagctcggaggatgaggttctggtgggcaacgctgccctctgccttggtaactgcatggaggtgcccaacgttgcgtcttccctgctaaagacggaccttttgcaggtcttgttaaagcttgcaggcagtgacacacagaagacggccgtgcaggtgaacgcaggcattgctctggggaagctgtgcacagctgagcccagagtgcctgccgagagcagtcatctccaatttggaagagagtctgctgcacctgaagctctgtctcctcgcaggtgggaagagatgtttcacatgctagtattctccctctccagtgtggatccacccccgccaccgccccaaacttgttacccctaa

SEQ ID NO: 31414 - DNA, 669 bp, Homo sapiens
ggtcactgcgccatttcctgtccaaagctgggcgaatcaggtccctaaatcgccggggttgatgttggctttggaagaactatttgcagagcgttttctgcactggaaggagggctggaagctttctggaagcattgccgcacgtaaatgagtgcctcttggcctaaaacagcagttggaatgaaagggatcaccctgctgttattcattgacataaacaaaactgtcataaaaataatcacttggctcttagttttagaaggctaataagcctgaccgttctgtttagtgctttattattattaatttcaccattatgctgcatcccttagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatg

SEQ ID NO: 31415 - DNA, 764 bp, Homo sapiens
ggtcactgcgccatttcctgtccaaagctgggcgaatcaggtccctaaatcgccggggttgatgttggctttggaagaactatttgcagagcgttttctgcactggaaggagggctggaagctttctggaagcattgccgcacggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaa

SEQ ID NO: 31416 - DNA, 830 bp, Homo sapiens
gtctggggcaggctccgcgcggggctcgggcacaggtccccgctgccgcagccctaccgagtgaagcactgagcgcggcgccgcttcgccatcacctggctctggccctctcaccctagcgtaggggggcactggccaggcagtgaggaccctgagatccatgccctgggagacagaggttgtctcctgtccatgcacccgcgcgcctgccttctaaccttcataccgttgggcagattaattcactggactaggcctctgttccgtgggagttgaaaagatttgacctggaagaaaccctagcgattattcaggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctca

SEQ ID NO: 31417 - DNA, 2315 bp, Homo sapiens
cttggtcccgccccgggcccctggctcctggccccgccccagcccaggcaggtcactgcgccatttcctgtccaaagctgggcgaatcagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgcacagaacaaactttattcagaatgcacaatggatttagtatcatcagtgacaacgaggtcataagaaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagttgagcgttatgatgaagctgctcagctcggaggatgaggttctggtgggcaacgctgccctctgccttggtaactgcatggaggtgcccaacgttgcgtcttccctgctaaagacggaccttttgcaggtcttgttaaagcttgcaggcagtgacacacagaagacggccgtgcaggtgaacgcaggcattgctctggggaagctgtgcacagctgagcccagatttgctgctcaactgagaaagcttcatggcctagaaattctcaactctacgatgaaatacatcagtgattcttgagagagacagggtttgtgtgcatttggggaacacacagatgcacaccgtgtgttgttcctatgctaataaagacctttgatgtatccacttca

SEQ ID NO: 31418 - DNA, 2788 bp, Homo sapiens
gatgccccgcccgcgcccatggcgcagccacacacgacctcggtcccgtacttcgcgcgctctcctgcaccgccgccgccatctcgctcaggagctcctccacaaccgccggcaacactacggccatcgcgccgcaggacacgccctccacgaccggcggaccgccgcgacgctccagctgactgcgcctacctgtggaggatcctgaccccccgccggggcagggcgagacggagtgacgtcggggcgcgtcatcgcgcgtgcggacgcagggatgtcctgctcagtcgtcagggcccggccaatccggagggcgctcggcgcgtggtcgggggccaggagcgcgtctggcctgcagtgcgcagaggacgcggcgggagcatgttccggctcctgagctggagcctgggccgaggcttcctgcgggccgcggggcggcggtgccggggctgctccgcgcgcctgctcccggggctggcaggaggtccggggcccgaggtgcaggtgccgccatcccgagtcgcgccgcacggccggggcccaggcctgctgccgctgctggcagcgctcgcctggttctcgaggcccgctgcggcagaggaggaggagcagcagggagccgacggggccgctgccgaggacggggcggacgaggccgaggcagagatcatccagctgctgaagcgagccaagttgagcattatgaaagatgagccagaagaggctgagttaattttgcatgacgctcttcgtctcgcctatcagactgataacaagaaggccatcacttacacttatgatttgatggccaacttagcatttatacggggtcagcttgaaaatgctgaacaactttttaaagcaacaatgagttacctccttggagggggcatgaagcaggaggacaatgcaataattgaaatttccctaaagctggccagtatctatgctgcgcagaacagacaggaatttgctgttgctggctatgaattctgcatttcaactctagaggaaaaaattgaaagagaaaaggaattagcagaagacattatgtcagtggaagagaaagccaatacccacctcctcttgggcatgtgcttagacgcctgtgctcgctaccttctgttctccaagcagccgtcacaggcacaaaggatgtatgaaaaagctctgcagatttctgaagaaatacaaggagaaagacacccacagaccattgtgctgatgagtgacctggctactaccctggatgcacagggccgctttgatgaggcctatatttatatgcaaagggcatcagatctggcaagacagataaatcatcctgagctacacatggtactcagtaatctagctgcagttttgatgcacagagaacgatatacacaagcaaaagagatctaccaggaagcactgaagcaagcaaagctgaaaaaagatgaaatttctgtacaacacatcagggaagagttggctgagctgtcaaagaaaagtagacctttgacaaattctgtcaagctctaaatccatttttgtgtagggagaataatgtctagtaatgtggaagaatagctatcattcctgtctctgtggcacccgatcaatggcttaaatctgtcgtttttgatattcaggtttcctcaatttagccttagtgaaggaggggttgtacacactgccatttttgtattttaaaggaaaaatgactttcattcccaactgattatgacctttcaggatgtcgtcaagtgatgctttcagttgtaacacgtgacttggtgctgtccctgctggtctaagtagaactgtagattcatatgggctggtgttcctgtgcgctgtgggtgtggtgattcagcctggcatttctaccataagtttttggtctgctgatttgctgccctgtcttctcttactttactttatcaatacctggcaaactgaccagaattaccttcctcatggcaaagggggattatggtgaattgttgttcttatagtctgtttcatgaagcacaagtggaatttaatacataaaagagaaaaatatcttagtttgctaccagcatccagcatgaagttgtaaagtggggattaggcacgtgacagtatagcacccatttgaatttaaataaaagtgaaccatatttatctggttatataaaactaaaaatgggggtgtttatataaaactaaaaactaagaatgatgtaaccttttgtctgtgttatctgaacactctacttcctttgcagccttagtcacacaactgagtcatctcaagtactctttaaggacacacagcccaggctgttctgagtcagaataggcccctacaggtatattttaaaactcttcgtaattctaatgtgtactgctggtatagctgaactactgacctggatcttagtcctagcctttttgcttttgcaatttcagtatcttcatctctaaactagggaaacactgggattctttcttagctgtgggggaaggtatttggttagatgactttgaatgaatagactgctgtgctgaaagagctttatcacactgtctcaaagtatgtaaagatacataggtggatgctcttactgcagcagtcatgaatacatttttagccatttacctaaggaaaaagacagtttttctaggtaccatgaaggaagattgaccctgttggtatgcctgtgggggtgggatgtgagtgggactgataaactgatacttttggttcgtatgtacatactggaagaatcttcataataaatgagactacacaacaata

SEQ ID NO: 31419 - DNA, 1662 bp, Homo sapiens
cgcagggatgtcctgctcagtcgtcagggcccggccaatccggagggcgctcggcgcgtggtcgggggccaggagcgcgtctggcctgcagtgcgcagaggacgcggcgggagcatgttccggctcctgagctggagcctgggccgaggcttcctgcgggccgcggggcggcggtgccggggctgctccgcgcgcctgctcccggggctggcaggaggtccggggcccgaggtgcaggtgccgccatcccgagtcgcgccgcacggccggggcccaggcctgctgccgctgctggcagcgctcgcctggttctcgaggcccgctgcggcagaggaggaggagcagcagggagccgacggggccgctgccgaggacggggcggacgaggccgaggcagagatcatccagctgctgaagcgagccaagttgagcattatgaaagatgagccagaagaggctgagttaattttgcatgacgctcttcgtctcgcctatcagactgataacaagaaggccatcacttacacttatgatttgatggccaacttagcatttatacggggtcagcttgaaaatgctgaacaactttttaaagcaacaatgagttacctccttggagggggcatgaagcaggaggacaatgcaataattgaaatttccctaaagctggccagtatctatgctgcgcagaacagacaggaatttgctgttgctggctatgaattctgcatttcaactctagaggaaaaaattgaaagagaaaaggaattagcagaagacattatgtcagtggaagagaaagccaatacccacctcctcttgggcatgtgcttagacgcctgtgctcgctaccttctgttctccaagcagccgtcacaggcacaaaggatgtatgaaaaagctctgcagatttctgaagaaatacaaggagaaagacacccacagaccattgtgctgatgagtgacctggctactaccctggatgcacagggccgctttgatgaggcctatatttatatgcaaagggcatcagatctggcaagacagataaatcatcctgagctacacatggtactcagtaatctagctgcagttttgatgcacagagaacgatatacacaagcaaaagagatctaccaggaagcactgaagcaagcaaagctgaaaaaagatgaaatttctgtacaacacatcagggaagagttggctgagctgtcaaagaaaagtagacctttgacaaattctgtcaagctctaaatccatttttgtgtagggagaataatgtctagtaatgtggaagaatagctatcattcctgtctctgtggcacccgatcaatggcttaaatctgtcgtttttgatattcaggtttcctcaatttagccttagtgaaggaggggttgtacacactgccatttttgtattttaaaggaaaaatgactttcattcccaactgattatgacctttcaggatgtcgtcaagtgatgctttcagttgtaacacgtgacttggtgctgtccctgctggtctaagtagaactgtagattcatatgggctggtgttcctgtgcgctgtgggtgtgtgggactgataaactgatacttttggttcgtatgtacatactggaagaatcttcataataaatgagactacacaacaata

SEQ ID NO: 31420 - DNA, 2784 bp, Homo sapiens
gatgccccgcccgcgcccatggcgcagccacacacgacctcggtcccgtacttcgcgcgctctcctgcaccgccgccgccatctcgctcaggagctcctccacaaccgccggcaacactacggccatcgcgccgcaggacacgccctccacgaccggcggaccgccgcgacgctccagctgactgcgcctacctgtggaggatcctgaccccccgccggggcagggcgagacggagtgacgtcggggcgcgtcatcgcgcgtgcggacgcagggatgtcctgctcagtcgtcagggcccggccaatccggagggcgctcggcgcgtggtcgggggccaggagcgcgtctggcctgcagtgcgcagaggacgcggcgggagcatgttccggctcctgagctggagcctgggccgaggcttcctgcgggccgcggggcggcggtgccggggctgctccgcgcgcctgctcccggggctggcaggaggtccggggcccgaggtgcaggtgccgccatcccgagtcgcgccgcacggccggggcccaggcctgctgccgctgctggcagcgctcgcctggttctcgaggcccgctgcggcagaggaggaggagcagcagggagccgacggggccgctgccgaggacggggcggacgaggccgaggcagagatcatccagctgctgaagcgagccaagttgagcattatgaaagatgagccagaagaggctgagttaattttgcatgacgctcttcgtctcgcctatcagactgataacaagaaggccatcacttacacttatgatttgatggccaacttagcatttatacggggtcagcttgaaaatgctgaacaactttttaaagcaacaatgagttacctccttggagggggcatgaagcaggaggacaatgcaataattgaaatttccctaaagctggccagtatctatgctgcgcagaacagacaggaatttgctgttgctggctatgaattctgcatttcaactctagaggaaaaaattgaaagagaaaaggaattagcagaagacattatgtcagtggaagagaaagccaatacccacctcctcttgggcatgtgcttagacgcctgtgctcgctaccttctgttctccaagcagccgtcacaggcacaaaggatgtatgaaaaagctctgcagatttctgaagaaatacaaggagaaagacacccacagaccattgtgctgatgagtgacctggctactaccctggatgcacagggccgctttgatgaggcctatatttatatgcaaagggcatcagatctggcaagacagataaatcatcctgagctacacatggtactcagtaatctagctgcagttttgatgcacagagaacgatatacacaagcaaaagagatctaccaggaagcactgaagcaagcaaagctgaaaaaagatgaaatttctgtacaacacatcagggaagagttggctgagctgtcaaagaaaagtagacctttgacaaattctgtcaagctctaaatccatttttgtgtagggagaataatgtctagtaatgtggaagaatagctatcattcctgtctctgtggcacccgatcaatggcttaaatctgtcgtttttgatattcaggtttcctcaatttagccttagtgaaggaggggttgtacacactgccatttttgtattttaaaggaaaaatgactttcattcccaactgattatgacctttcaggatgtcgtcaagtgatgctttcagttgtaacacgtgacttggtgctgtccctgctggtctaagtagaactgtagattcatatgggctggtgttcctgtgcgctgtgggtgtggtgattcagcctggcatttctaccataagtttttggtctgctgatttgctgccctgtcttctcttactttactttatcaatacctggcaaactgaccagaattaccttcctcatggcaaagggggattatggtgaattgttgttcttatagtctgtttcatgaagcacaagtggaatttaatacataaaagagaaaaatatcttagtttgctaccagcatccagcatgaagttgtaaagtggggattaggcacgtgacagtatagcacccatttgaatttaaataaaagtgaaccatatttatctggttatataaaactaaaaatgggggtgtttatataaaactaaaaactaagaatgatgtaaccttttgtctgtgttatctgaacactctacttcctttgcagccttagtcacacaactgagtcatctcaagtactctttaaggacacacagcccaggctgttctgagtcagaataggcccctacaggtatattttaaaactcttcgtaattctaatgtgtactgctggtatagctgaactactgacctggatcttagtcctagcctttttgcttttgcaatttcagtatcttcatctctaaactagggaaacactgggattctttcttagctgtgggggaaggtatttggttagatgactttgaatgaatagactgctgtgctgaaagagctttatcacactgtctcaaagtatgtaaagatacataggtggatgctcttactgcagcagtcatgaatacatttttagccatttacctaaggaaaaagacagtttttctaggtaccatgaaggaagattgaccctgttggtatgcctgtgggggtgggatgtgagtgggactgataaactgatacttttggttcgtatgtacatactggaagaatcttcataataaatgagactacacaac

SEQ ID NO: 31421 - DNA, 2591 bp, Homo sapiens
gccaggagcgcgtctggcctgcagtgcgcagaggacgcggcgggagcatgttccggctcctgagctggagcctgggccgaggcttcctgcgggccgcggggcggcggtgccggggctgctccgcgcgcctgctcccggggctggcaggaggtccggggcccgaggtgcaggtgccgccatcccgagtcgcgccgcacggccggggcccaggcctgctgccgctgctggcagcgctcgcctggttctcgaggcccgctgcggcagaggaggaggagcagcagggagccgacggggccgctgccgaggacggggcggacgaggccgaggcagagatcatccagctgctgaagcgagccaaggtgaggcggctccgggccctgcgcccggccgagcgcggtagcctttgtgagcggggtcttggcgttgctgcgcattactctctccgcctcgccgaagagtggatggaggctccgcgggtaaaattgccgagaatgagttgagcattatgaaagatgagccagaagaggctgagttaattttgcatgacgctcttcgtctcgcctatcagactgataacaagaaggccatcacttacacttatgatttgatggccaacttagcatttatacggggtcagcttgaaaatgctgaacaactttttaaagcaacaatgagttacctccttggagggggcatgaagcaggaggacaatgcaataattgaaatttccctaaagctggccagtatctatgctgcgcagaacagacaggaatttgctgttgctggctatgaattctgcatttcaactctagaggaaaaaattgaaagagaaaaggaattagcagaagacattatgtcagtggaagagaaagccaatacccacctcctcttgggcatgtgcttagacgcctgtgctcgctaccttctgttctccaagcagccgtcacaggcacaaaggatgtatgaaaaagctctgcagatttctgaagaaatacaaggagaaagacacccacagaccattgtgctgatgagtgacctggctactaccctggatgcacagggccgctttgatgaggcctatatttatatgcaaagggcatcagatctggcaagacagataaatcatcctgagctacacatggtactcagtaatctagctgcagttttgatgcacagagaacgatatacacaagcaaaagagatctaccaggaagcactgaagcaagcaaagctgaaaaaagatgaaatttctgtacaacacatcagggaagagttggctgagctgtcaaagaaaagtagacctttgacaaattctgtcaagctctaaatccatttttgtgtagggagaataatgtctagtaatgtggaagaatagctatcattcctgtctctgtggcacccgatcaatggcttaaatctgtcgtttttgatattcaggtttcctcaatttagccttagtgaaggaggggttgtacacactgccatttttgtattttaaaggaaaaatgactttcattcccaactgattatgacctttcaggatgtcgtcaagtgatgctttcagttgtaacacgtgacttggtgctgtccctgctggtctaagtagaactgtagattcatatgggctggtgttcctgtgcgctgtgggtgtggtgattcagcctggcatttctaccataagtttttggtctgctgatttgctgccctgtcttctcttactttactttatcaatacctggcaaactgaccagaattaccttcctcatggcaaagggggattatggtgaattgttgttcttatagtctgtttcatgaagcacaagtggaatttaatacataaaagagaaaaatatcttagtttgctaccagcatccagcatgaagttgtaaagtggggattaggcacgtgacagtatagcacccatttgaatttaaataaaagtgaaccatatttatctggttatataaaactaaaaatgggggtgtttatataaaactaaaaactaagaatgatgtaaccttttgtctgtgttatctgaacactctacttcctttgcagccttagtcacacaactgagtcatctcaagtactctttaaggacacacagcccaggctgttctgagtcagaataggcccctacaggtatattttaaaactcttcgtaattctaatgtgtactgctggtatagctgaactactgacctggatcttagtcctagcctttttgcttttgcaatttcagtatcttcatctctaaactagggaaacactgggattctttcttagctgtgggggaaggtatttggttagatgactttgaatgaatagactgctgtgctgaaagagctttatcacactgtctcaaagtatgtaaagatacataggtggatgctcttactgcagcagtcatgaatacatttttagccatttacctaaggaaaaagacagtttttctaggtaccatgaaggaagattgaccctgttggtatgcctgtgggggtgggatgtgagtgggactgataaactgatacttttggttcgtatgtacatactggaagaatcttcataataaatgagactacacaacaata

SEQ ID NO: 31422 - DNA, 5482 bp, Homo sapiens
gcggcgcgaccccgcccctcccgctggggcccggggcgctagagcgctccgggaggctaggggagctgaattctgcgtcttcctttaggctgcggcgagacaatccccagagccccgcggcccggcctcggggcagccatggactcgcaggaattgaagactttgattaattactattgtcaagagagatatttccatcatgtattactggttgccagtgaaggaattaagaggtatggaagtgatccagtcttcaggttttatcatgcctatggcacattaatggaaggtaaaactcaagaagctcttcgagaatttgaggctattaaaaataaacaagatgtatcactttgttctctacttgcactgatatatgcccataaaatgagtcctaatccagatagagaagctattctggaatcagatgccagagtgaaggaacaacgtaaaggagctggagagaaagccttataccatgcaggcttatttttatggcacattggtcgccatgataaagcaagggaatatattgacagaatgatcaaaatatcagatggtagtaaacagggacacgttttgaaagcatggcttgatattacaagaggaaaagagccttacactaaaaaagcactgaagtattttgaagagggactccaagatgggaatgatacttttgctctgctgggtaaggcacaatgccttgagatgcgccagaattattcaggtgccctggagactgtgaaccagataatcgtgaattttccgagcttccttcctgcttttgttaagaaaatgaaattacaactagccttgcaggattgggaccagacagttgagacagcacaaaggttgctgctccaagatagccaaaatgtggaagcactgagaatgcaggcactctactatgtgtgtagagagggggatatagagaaggcttccaccaagctggaaaacttgggaaatacattggatgccatggaaccacagaatgctcaacttttctataacattacactcgccttcagcagaacttgtggacgtagtcaacttattcttcaaaaaattcaaacgttacttgagagagcttttagtttaaaccctcagcaatcagaatttgctacagaacttggataccaaatgattttacaaggaagagttaaagaggcactgaagtggtataagaccgccatgacacttgatgagactagtgtgtctgccctagttggatttatccaatgtcagttgatagaagggcaattacaggatgcagatcagcagctagaatttttaaatgaaatccagcaatccattggaaaatctgcggaattaatctatttacatgcagttcttgccatgaagaaaaataaacgacaagaagaagttattaatttgttaaatgatgtcctggacactcacttttcacaattagaaggtttgcctcttggcatacagtattttgaaaagctaaatcctgatttcttgttagaaattgttatggagtatctgagcttctgtccaatgcagcctgcaagtcctgggcaacctctttgtccacttctcaggcgttgcatctcagtcctggagactgtagtaagaactgttccaggtcttctgcaaacagtcttcctaatagcaaaagtgaaatatttgtcaggtgatattgaagcagctttcaataaccttcagcactgcttagaacacaatccctcttatgctgatgctcatctgctgctagctcaggtttacttgtctcaagaaaaagtcaaattgtgttctcagtctcttgaactttgtctgagctatgattttaaggtgagagactatcctttataccatttgataaaagctcagtcacaaaagaaaatgggagaaatagcagacgcaattaaaacactgcatatggcaatgagtttaccaggaatgaaaagaattggagcttccacaaaatcaaaagacagaaaaactgaagttgatacaagccatcgtttatcgatctttcttgaattgatagacgttcaccgcttaaatggagagcagcatgaggcaaccaaagttttacaagatgccatccatgaattttctggaacatctgaagaagtgcgggttaccattgctaatgcagaccttgctctagcccaaggagatattgaacgggctttaagcatccttcagaatgttacagccgaacagccttattttatagaggccagagaaaaaatggcagatatttatctgaagcacagaaaagataaaatgttatatatcacttgttttagagaaattgctgaaagaatggctaaccctcggtcttttcttctccttggtgatgcatacatgaatattctagagcctgaagaagccatagtagcatatgagcaagcattaaatcagaacccgaaagatggaacattggcaagcaaaatgggcaaagcacttatcaaaactcataactactcaatggcaatcacttactatgaagctgctctgaaaactggacaaaagaattatctttgctatgacctggctgagctcttattaaaattgaaatggtatgacaaagcagaaaaagttcttcagcatgctctggctcatgaacctgtaaatgaactgtcagctctcatggaggatggacgttgtcaagttcttctagcaaaagtttatagtaaaatggaaaaacttggtgatgcgatcactgcattacaacaggctcgagaattacaagctcgggtactaaaacgtgttcagatggaacagccagatgcagttcctgcacagaaacatttagcagctgaaatttgtgcagagattgcaaaacattctgttgctcagcgagactatgaaaaagcaattaagttttatagagaggctctggttcactgcgaaacagataataagattatgttggaactggcacgattatacctggcacaagatgaccctgattcctgcctgcggcagtgtgctctactgcttcagagtgaccaggataacgaagctgctaccatgatgatggctgatctcatgttcagaaaacaagactatgaacaagcagtgtttcatttacagcagcttttagaacgtaagccagataattatatgacattatctcgtttgattgatctcctaagaagatgtggaaaactcgaggatgtcccaagatttttctcaatggctgagaaacgtaactccagagcaaaattggaaccaggatttcagtattgtaaaggactgtatctttggtacactggagaaccaaatgatgcccttcgacattttaataaagctcggaaagatcgtgactggggccaaaatgccctttataatatgatagagatctgtttgaatccagataatgaaactgttggaggtgaagtatttgaaaacctggatggagacctgggtaattcaactgagaagcaagaatctgtgcaactggcagtaagaacagcagaaaaacttcttaaggaactaaaacctcagactgttcagggtcacgtacagcttcgcataatggaaaactattgcttaatggctaccaaacagaaatctaatgttgaacaagcattaaataccttcactgaaatagcagcatctgagaaggagcatatcccagcgctcttgggaatggcaacggcttatatgatcttgaaacagactccacgagccagaaaccagctgaagcgtattgcgaaaatgaattggaatgctattgatgctgaagagtttgagaagagttggctgctacttgctgatatttacattcaatcagcaaaatatgacatggcagaagacctgttaaaacggtgcctgcgtcataatagatcttgctgcaaagcttatgaatatatgggatacattatggaaaaagagcaagcatatacagatgctgccttgaactatgagatggcatggaaatatagcaatcggacaaatccggcagtaggatacaaactggcatttaattacttaaaagcaaaaagatatgtggattcaattgacatatgtcaccaggttcttgaagcacatccaacttatccaaaaatcagaaaggatatacttgataaggcccgtgcgtctttaagaccttgaaaataattttaacttaggtgttggtttaacaggaaatgaaagaaatctaactttcagttcttcctgttcaaaacaggtttgagctcagtgctttgttattagaagtatacccttttttctccagcagaggttgctgctgtacatcaagagaagtactatgtgaaattggtgtttcctaatggagttgaatgagagctggtctatttgactctgttttgattgggtacagatttggtgactctgtggtaaagactataattatttctataaagaatattttgttaaaatctaggtaattaaataccctgtatcttttctaaggaatattatttcaggaaatatatttaaaatgcattgttctcttttaaagtgtttttgttatattcttttatttatttatttatttttaaagacagagccttgatctgccgcccaggctggagtgcagtggcacgatcttggctcactgcaacctccgcctcctgggtttacgcgattctcctgcttcagcctcccgagtagctgggactaaaggcatgtgccatcacacccggctaattttttgtatttttagtagagatgggatttcaccgtgttagccaggaggggcttgatctcttgaccttgtgatccacctgcctcggcctcccaaagtgctgggattacaggcatgagccaccgcacccagcctgtttttgttgtattctgtgttgtttcaaaaattggaataaatctccctgtaaataactcatgaaaaagacaatatatatattttaaatatatattttaataaaggttttataaatagatgatttatattcctcttggaactcaaaagatgtggtaagttttgcaaatcagggtaagctccccctgcattctgtaatgttaatgggtggtggtatagtacagaaaatgtaactttcattgaaaaatcttttttagaaaagggtagagtgtgtgtttccctttcctttcttgagctcattcttcctgctttcaaggccattgtggtcttaagaaataatcaggtcctgaaacctcaatttaaataggtcccttattagggatatttaaccttagcctagaagacttggtctgcaggtataatttcagacactgtaacatttgatggtaaagggtgaccaaatacttttggtcagcagggagtcacaaagcacaccatgtgaaggcaacggtttacccagctctgtttaacagcaccctggcatagaagctttcactctcttacactaaatttaacctaatctaaacttaatccttagcattatttttaatttctcatctacatctttttcaattttccttaaaattgtagtaaacacagtcctcaattttatttgcatttacaataaacagtatttataagtca

SEQ ID NO: 31423 - DNA, 1589 bp, Homo sapiens
taaaggactgtatctttggtacactggagaaccaaatgatgcccttcgacattttaataaagctcggaaagatcgtgactggggccaaaatgccctttataatatgatagagatctgtttgaatccagataatgaaactgttggaggtgaagtatttgaaaacctggatggagacctgggtaattcaactgagaagcaagaatctgtgcaactggcagtaagaacagcagaaaaacttcttaaggaactaaaacctcagactgttcagggtcacgtacagcttcgcataatggaaaactattgcttaatggctaccaaacagaaatctaatgttgaacaagcattaaataccttcactgaaatagcagcatctgagaaggagcatatcccagcgctcttgggaatggcaacggcttatatgatcttgaaacagactccacgagccagaaaccagctgaagcgtattgcgaaaatgaattggaatgctattgatgctgaagagtttgagaagagttggctgctacttgctgatatttacattcaatcagcaaaatatgacatggcagaagacctgttaaaacggtgcctgcgtcataatagatcttgctgcaaagcttatgaatatatgggatacattatggaaaaagagcaagcatatacagatgctgccttgaactatgagatggcatggaaatatagcaatcggacaaatccggcagtaggatacaaactggcatttaattacttaaaagcaaaaagatatgtggattcaattgacatatgtcaccaggttcttgaagcacatccaacttatccaaaaatcagaaaggatatacttgataaggcccgtgcgtctttaagaccttgaaaataattttaacttaggtgttggtttaacaggaaatgaaagaaatctaactttcagttcttcctgttcaaaacaggatttgattgccttatgtgacaagcccaagatctgtgacagttggagctcaaactaggcagtcttgattccagactgctctgaactagtatttgaaggaactaatgaacatgacatgttaaatgaaagtttggggacgtacactcaggatggaagcagggggacacaacagaaatgaaagaattttctgtagatctgggatctggacacctgccccccgtcatgaataaatgccatcccttcccacgccaaccatatcgatgatatagtggcaggaaggagagtaagggactctggagcttaaacagaccatcacatgggaaggcagtaaacaagatgctaactgatggagtgaaatccccaggagatgcagaaggcaagtgcagctaactgaggcctcaggggcaggagatgcccatcaggatgagagctatgtctttctccagtgatgactctgcttctatgaggtcaccagcagtagaaccatatcttgctggcatacacttgggatggccccgcctcctggacttccatctgtcatcaggagaacataaccatctggagtcagtacagatcatcaatccttccacatatacaagttcattttaaatttttaaaaatataatacaactgagaagtcttcatt

SEQ ID NO: 31424 - DNA, 9084 bp, Homo sapiens
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaacccttagtctgaaactttaccaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtaaacaggttaacttagagtagagatggtgaatatgtgaacctgaggaaaggaagaaatagattaaattatctggagagagaggaaaagtcagcagaatggggacgagaatctttcggagctcagtgttctgataggagttatttccttgggcataggttccaagtatttttctaatataccatagaagccaggaaaactttcttctgttatctcaaatgatttaattactgacttgagtttgtgttgtctccttagacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaagttca

SEQ ID NO: 31425 - DNA, 7712 bp, Homo sapiens
gtcggctgacgtggagggccggaggtggcggcggcggcggcggcggctgctgctgctgctgcccgcgtccgaggctcgcgggcggcgggcccggacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatg

SEQ ID NO: 31426 - DNA, 10363 bp, Homo sapiens
tgtattctttaaatattatgtctcattagtctcttctctcctgctggaactttaactggatatatatatacactaaactgtttccagatcacttattctttatctttcatattttttatctctttgtttctctttaccagaatttacagtgctggataatttcataaggcatatattttagttcaccaattttctcttcaactgtgcctaatatcctctgtaacccatcctgtctcttttttttcttttaacaattgcatttttaattactttttttttttttttttaagatggagtctctctctgtcgcccaggctggagtgcagaggcgcgatctcagctcactgcaagctccgcctcccgggttcacgccattctcctgcctcagcctcccgagtagctgggactacaggcgcccgccaccacgcccggctaatttttttgtatttttagtagagacggggtttcaccgtgttacccaggatggtctcgatctcctgacctcgtcatctgctcacgttggcctcccagagtgctgggattacaggcatgagccaccatgcccggccgcatttttaatttctaaaagttctgcctggttcttttttgatatgtccagtcattcttcatgttctcatgttatatgctgatttttgtgactctatagctattctgtagactatatcagacattcccaatgtctgatatccttgaggagggggatgtctaaatttattgcttttttgtttttttttctgttgtctctcctcaatgtagctgtcacctcatgtgtttggtgatcattgattatgaacttctgtttgatctttgtggtgatcttgagagtctaatttgaggatgcttgctttctgaaagcatttctatcagctttgtctgggagccagaaagtttagctggcatcacttttgagttcctacattttgcttctggcccagggctcagtgtcctgatcctattactgctcttggcaccactacttgtagcactaaactgtagccaggtttaatttctagctcaaggtttgttgcttttgcgtggagagggtgccttcacatgttcccctatttctatgagctcagcaaaaacatccaaaaagtgtttttttttttaatctaggatatacctttttcctcccaacagtacattcccccagagtgtatagttgaccataactgatgggatcagaagctctttattttaatatttaattttagtagtatatttttgtttgattgtattataaaaaattttatggtaccaagcaagctttcttggtgataccaacatttccattaaaactagtttacatctaagttaagatttgagttatcctaaagaaaagtattaagtaaatagcagtacagatggcaaatggattgcacaatatatcctctggatccatagtgaccctgcagagataaacctgtgatggtcaaacaatgtgaaaactgctgtcagagacatgggcagggtgctcttgtttacagagaagaggtgcaaaaatcaacttgatggtagtgggaagatcaggaaatgcttcctgaaattgagtattaagaactaatagacattaggtggttgcagaataagttttgtttaggaaggacaagcagttgggtatgactggcttctaggttgtgtgttgtggagtgactggggataaaagcaggagcaagatcacaaaaggtcttctatgcttatattagggaagttggactttattctcaagctgaagggaagctgttgcatggttttaagcagtaaagtgatatgatcagagttttagaggatgccaagattgaaggcaagtctgaccagttaggagactgcttgttaaattagttcagaggagaaacagtgaaggcagtggcactgggcatgaagaagtatatgtgtgctaattttagatttcttagggaagcagaaatgacaagagttagtggtccattggacagaaatattgaaggagactggggagtctaggttgactcccagggtttaggtttgggcagtaaaatgacatgtagaacaattaactgataaacagcatacagaaagaggaaagaacttcatttcatatgtttgtttttgaggaaaagatgtttgtttttgaacttcctgattcagaggggcttgtgggacatcttggttaagatcctgtagtagttctagtagggtctagaagtcaagagatacaaccccgcctggaaggatttgggagtcttcagcatttggaattttggaagccattgtttactgcagtgcatatgagataatttaaactggtacatagataaacacttgaaaaaattttaatagataggaatttaatgtgtatgagaaacataacttgcacatctaacctttgataatcatggacattatcacttaggccaagtgagctcaataaaagggaaatattaactaaaaatatatgtgatacatggaaatggcaaaaatcacggtgaagctatgcaaacgatgcaagttcagaaagtgctgtgttaagtcatgggtgtggtggataaattcacccaaggagagagtaagagtgagaagaaaagagagttgacattgggtggcggggaatggagaagaagaacccatgaaggaaactgaggaagagcagccagacgaataggaggaaaaccaggagaagatggtctttggagtccaaatgaagagttctgaggaggaagtggtccacagcgtcaaacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaagttca

SEQ ID NO: 31427 - DNA, 3771 bp, Homo sapiens
gccacccgctccctcccgccgtcggctgacgtggagggccggaggtggcggcggcggcggcggcggctgctgctgctgctgcccgcgtccgaggctcgcgggcggcgggcccgggtgagtgcacacccggcgcgctgccgggctcccggatgtgtcaccttgtcccgctgcagccgagatgccgggggagcggggccttccacaccccctccgtgggtgtgtgacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaag

SEQ ID NO: 31428 - DNA, 2451 bp, Homo sapiens
cgccgtcggctgacgtggagggccggaggtggcggcggcggcggcggcggctgctgctgctgctgcccgcgtccgaggctcgcgggcggcgggcccggacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaa

SEQ ID NO: 31429 - DNA, 2025 bp, Homo sapiens
gtggagggccggaggtggcggcggcggcggcggcggctgctgctgctgctgcccgcgtccgaggctcgcgggcggcgggcccggaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggtatgtccctttatattccagagcaataaactttaatacgaagggg

SEQ ID NO: 31430 - DNA, 3053 bp, Homo sapiens
aagtggcccggccagcggcgcggcgtccggggaggaaatggatgctgtgctggcctgccggctccgggggcggggaaatcgagtagctgcactcaggccccgcccgagacccggagggagcgccgggccgtccccttttgccctcctttgcgctgggctgagcccagagccgagagcaggagtcggctctgagttccctgcttggtttttgggtggcagcagccagaggaggaatatggcgctcttaggcagccgagcggagctggaagcggacgaggacgttttcgaagatgccttggaaaccatctcaatggctaaggagagtatgtaccatgccttgggctacagtaccattgtggtgttgcaggctgtcctgaccttcgagcaacaggacatccagaacggcatttctgccatgaaggacgctttacaaacctgccaaaaatacaggaaaaaatacacagttgtagaatctttctcaagtcttctttctagaggatccctggagcaactgagtgaagaggaaatgcatgctgaaatctgttatgccgagtgtctcctacagaaagctgcactcacgtttgtgcaggatgaaaatatgatcaacttcatcaaaggtggactcaaaattagaacaagttaccaaatatataaagaatgtctttctatcctgcatgaaattcagaagaacaaacttcagcaggaattcttctatgagtttgaagggggtgtcaagcttggcagtggggcctttaatttgatgctgtcccttttaccagcaaggattatcagactactagaatttattggattttctgggaatagggagttgggcctcctgcagttacgtgaaggtgcttcaggaaggagcatgaggtctgcactgtgctgcttaaccatcttagcttttcatacttacatctccctaatacttggtacaggagaagtgaatgttgcggaagcagagcgtctcctggcacccttcctccagcagtttccaaatggctcactcgtgttgttttatcatgcccgaatagagttgctgaaagggaatcttgaagaggcacaagaagtatttcaaaaatgcatttcagttcaagaagaatggaaacagtttcaccatctctgctactgggagctaatgtggattaatgttttccaacaaaactggatgcaggcatattactattcagatctgctttgcaaagagagtaaatggtccaaggcaacttatgtgttcttgaaagcagcaattttgagtatgcttccagaggaggatgtagtagcaacgaatgagaatgtggtaactttattcagacaggtggacagcttgaagcagagaattgccgggaaatctatccctactgagaagtttgctgtgaggaaggctcggcgttactccgcctccttacctgcacctgtgaagctcatcttacctgccctggaaatgatgtatgtctggaatggtttttcaatagtgagcaaaagaaaagacctttctgaaaatctgttagtaactgttgaaaaagctgaggcagctttacaaagtcaaaattttaacagcttctctgtggatgatgagtgcttagtgaagttacttaaaggatgttgcctcaagaacttacagcggcccttgcaagctgaactatgttacaatcatgttgtggaaagtgaaaagctactgaagtatgaccactacctagtgccgttcactctatttgaattggcatctttgtataaaagccagggggaaattgacaaggccataaagttcctagaaactgcaaggaacaactacaaagattactccctggagtccagactacacttcagaattcaggcagctcttcacctctggagaaaaccttcctcagattgatcagaacttgaaggatggaatttttcctcaattagcatcggcatctgctatagattcaaccttatattaaagtggaaaaatgatcttgtgaataagagacaaaaaaacagtttttttggtcaatattttctatcatctgagagatttactgttggtctacataattttttttcctatggaatggcattctatattatctagaaaattcttatattttgcctcccccaaaagaatttcatattatttgaattagggggcgaagaagtcttttgaaagacttgcagatgcaatagtctaattagattatttatttttttaatgtgaaaattaatattgtttagcaaatagcttacaagttgagccaattttggatttgttgggtagttaaacttcagagatattttgttgcctgtatttaaatttcagaagataaataaatatcattgcatttaaaatagcttaacagtgaccttcagaagacttctgaaaaagacagtctgagaacatgaacacggatcgatataatgtacttcatgggttgaagagacctttctctataaaggatgatgcagtattcagttagtggttttttactcttcatttgattaaaggtggtgacgttttggagagactgattttgaatgtacttaagtctattataataacaaaattcaaaacccctgtgtatctaaagggaaggaagtgtcatattttaggaatttttcttaaccttagcaatgagagcctaaaatacatacatggattatttttcttctaggaagtaaatttcctgctgctttaaatgatatgtaaaatatcaataatttttacacttaagatgttggtaagacctagttttctaatctctctagcactgtgatgtctccttgtagataatctggaccttgcttagtcctttagttgggaaacagaatcagggcatagagcagaagagagcttgacactccatatggtcctggttctgctacccattagcgattagtgaggagacctttagggagtccactgtgccctgtgtgtcaccacattttcttctgtgaaatcaagattaaagaacagatgactttcaaggtctttttcagttttataactgtgagtctatgtattaggtatttattttcaacaaatgactttaaaatgtcgaatgcaaacc

SEQ ID NO: 31431 - DNA, 3260 bp, Homo sapiens
aagtggcccggccagcggcgcggcgtccggggaggaaatggatgctgtgctggcctgccggctccgggggcggggaaatcgagtagctgcactcaggccccgcccgagacccggagggagcgccgggccgtccccttttgccctcctttgcgctgggctgagcccagagccgagagcaggagtcggctctgagttccctgcttggtttttgggtggcagcagccagaggaggaatatggcgctcttaggcagccgagcggagctggaagcggacgaggacgttttcgaagatgccttggaaaccatctcaatatcttctcactcagatatggcaacaagcagccttcactttgcatcatgtgatacacaacaggcgcccagacagcgcggagcgtctactgtcagcagttcatcatcaaccaaggtggatctcaagagtggcctcgaagaatgtgctgtggcattgaacttatttctaagcaacaaatttacagacgccttagaattgcttcgcccctgggctaaggagagtatgtaccatgccttgggctacagtaccattgtggtgttgcaggctgtcctgaccttcgagcaacaggacatccagaacggcatttctgccatgaaggacgctttacaaacctgccaaaaatacaggaaaaaatacacagttgtagaatctttctcaagtcttctttctagaggatccctggagcaactgagtgaagaggaaatgcatgctgaaatctgttatgccgagtgtctcctacagaaagctgcactcacgtttgtgcaggatgaaaatatgatcaacttcatcaaaggtggactcaaaattagaacaagttaccaaatatataaagaatgtctttctatcctgcatgaaattcagaagaacaaacttcagcaggaattcttctatgagtttgaagggggtgtcaagcttggcagtggggcctttaatttgatgctgtcccttttaccagcaaggattatcagactactagaatttattggattttctgggaatagggagttgggcctcctgcagttacgtgaaggtgcttcaggaaggagcatgaggtctgcactgtgctgcttaaccatcttagcttttcatacttacatctccctaatacttggtacaggagaagtgaatgttgcggaagcagagcgtctcctggcacccttcctccagcagtttccaaatggctcactcgtgttgttttatcatgcccgaatagagttgctgaaagggaatcttgaagaggcacaagaagtatttcaaaaatgcatttcagttcaagaagaatggaaacagtttcaccatctctgctactgggagctaatgtggattaatgttttccaacaaaactggatgcaggcatattactattcagatctgctttgcaaagagagtaaatggtccaaggcaacttatgtgttcttgaaagcagcaattttgagtatgcttccagaggaggatgtagtagcaacgaatgagaatgtggtaactttattcagacaggtggacagcttgaagcagagaattgccgggaaatctatccctactgagaagtttgctgtgaggaaggctcggcgttactccgcctccttacctgcacctgtgaagctcatcttacctgccctggaaatgatgtatgtctggaatggtttttcaatagtgagcaaaagaaaagacctttctgaaaatctgttagtaactgttgaaaaagctgaggcagctttacaaagtcaaaattttaacagcttctctgtggatgatgagtgcttagtgaagttacttaaaggatgttgcctcaagaacttacagcggcccttgcaagctgaactatgttacaatcatgttgtggaaagtgaaaagctactgaagtatgaccactacctagtgccgttcactctatttgaattggcatctttgtataaaagccagggggaaattgacaaggccataaagttcctagaaactgcaaggaacaactacaaagattactccctggagtccagactacacttcagaattcaggcagctcttcacctctggagaaaaccttcctcagattgatcagaacttgaaggatggaatttttcctcaattagcatcggcatctgctatagattcaaccttatattaaagtggaaaaatgatcttgtgaataagagacaaaaaaacagtttttttggtcaatattttctatcatctgagagatttactgttggtctacataattttttttcctatggaatggcattctatattatctagaaaattcttatattttgcctcccccaaaagaatttcatattatttgaattagggggcgaagaagtcttttgaaagacttgcagatgcaatagtctaattagattatttatttttttaatgtgaaaattaatattgtttagcaaatagcttacaagttgagccaattttggatttgttgggtagttaaacttcagagatattttgttgcctgtatttaaatttcagaagataaataaatatcattgcatttaaaatagcttaacagtgaccttcagaagacttctgaaaaagacagtctgagaacatgaacacggatcgatataatgtacttcatgggttgaagagacctttctctataaaggatgatgcagtattcagttagtggttttttactcttcatttgattaaaggtggtgacgttttggagagactgattttgaatgtacttaagtctattataataacaaaattcaaaacccctgtgtatctaaagggaaggaagtgtcatattttaggaatttttcttaaccttagcaatgagagcctaaaatacatacatggattatttttcttctaggaagtaaatttcctgctgctttaaatgatatgtaaaatatcaataatttttacacttaagatgttggtaagacctagttttctaatctctctagcactgtgatgtctccttgtagataatctggaccttgcttagtcctttagttgggaaacagaatcagggcatagagcagaagagagcttgacactccatatggtcctggttctgctacccattagcgattagtgaggagacctttagggagtccactgtgccctgtgtgtcaccacattttcttctgtgaaatcaagattaaagaacagatgactttcaaggtctttttcagttttataactgtgagtctatgtattaggtatttattttcaacaaatgactttaaaatgtcgaatgcaaacc

SEQ ID NO: 31432 - DNA, 3221 bp, Homo sapiens
aagtggcccggccagcggcgcggcgtccggggaggaaatggatgctgtgctggcctgccggctccgggggcggggaaatcgagtagctgcactcaggccccgcccgagacccggagggagcgccgggccgtccccttttgccctcctttgcgctgggctgagcccagagccgagagcaggagtcggctctgagttccctgcttggtttttgggtggcagcagccagaggaggaatatggcgctcttaggcagccgagcggagctggaagcggacgaggacgttttcgaagatgccttggaaaccatctcaatatcttctcactcagatatggcaacaagcagccttcactttgcatcatgtgatacacaacaggcgcccagacagcgcggagcgtctactgtcagcagttcatcatcaaccaaggtggatctcaagagtggcctcgaagaatgtgctgtggcattgaacttatttctaagcaacaaatttacagacgccttagaattgcttcgcccctgggctaaggagagtatgtaccatgccttgggctacagtaccattgtggtgttgcaggctgtcctgaccttcgagcaacaggacatccagaacggcatttctgccatgaaggacgctttacaaacctgccaaaaatacaggaaaaaatacacagttgtagaatctttctcaagtcttctttctagaggatccctggagcaactgagtgaagaggaaatgcatgctgaaatctgttatgccgagtgtctcctacagaaagctgcactcacgtttgtgcaggatgaaaatatgatcaacttcatcaaaggtggactcaaaattagaacaagttaccaaatatataaagaatgtctttctatcctgcatgaaattcagaagaacaaacttcagcaggaattcttctatgagtttgaagggggtgtcaagcttggcagtggggcctttaatttgatgctgtcccttttaccagcaaggattatcagactactagaatttattggattttctgggaatagggagttgggcctcctgcagttacgtgaaggtgcttcaggaaggagcatgaggtctgcactgtgctgcttaaccatcttagcttttcatacttacatctccctaatacttggtacaggagaagtgaatgttgcggaagcagagcgtctcctggcacccttcctccagcagtttccaaatgtacgctcagtatttcaaagtgcacaagaagtatttcaaaaatgcatttcagttcaagaagaatggaaacagtttcaccatctctgctactgggagctaatgtggattaatgttttccaacaaaactggatgcaggcatattactattcagatctgctttgcaaagagagtaaatggtccaaggcaacttatgtgttcttgaaagcagcaattttgagtatgcttccagaggaggatgtagtagcaacgaatgagaatgtggtaactttattcagacaggtggacagcttgaagcagagaattgccgggaaatctatccctactgagaagtttgctgtgaggaaggctcggcgttactccgcctccttacctgcacctgtgaagctcatcttacctgccctggaaatgatgtatgtctggaatggtttttcaatagtgagcaaaagaaaagacctttctgaaaatctgttagtaactgttgaaaaagctgaggcagctttacaaagtcaaaattttaacagcttctctgtggatgatgagtgcttagtgaagttacttaaaggatgttgcctcaagaacttacagcggcccttgcaagctgaactatgttacaatcatgttgtggaaagtgaaaagctactgaagtatgaccactacctagtgccgttcactctatttgaattggcatctttgtataaaagccagggggaaattgacaaggccataaagttcctagaaactgcaaggaacaactacaaagattactccctggagtccagactacacttcagaattcaggcagctcttcacctctggagaaaaccttcctcagattgatcagaacttgaaggatggaatttttcctcaattagcatcggcatctgctatagattcaaccttatattaaagtggaaaaatgatcttgtgaataagagacaaaaaaacagtttttttggtcaatattttctatcatctgagagatttactgttggtctacataattttttttcctatggaatggcattctatattatctagaaaattcttatattttgcctcccccaaaagaatttcatattatttgaattagggggcgaagaagtcttttgaaagacttgcagatgcaatagtctaattagattatttatttttttaatgtgaaaattaatattgtttagcaaatagcttacaagttgagccaattttggatttgttgggtagttaaacttcagagatattttgttgcctgtatttaaatttcagaagataaataaatatcattgcatttaaaatagcttaacagtgaccttcagaagacttctgaaaaagacagtctgagaacatgaacacggatcgatataatgtacttcatgggttgaagagacctttctctataaaggatgatgcagtattcagttagtggttttttactcttcatttgattaaaggtggtgacgttttggagagactgattttgaatgtacttaagtctattataataacaaaattcaaaacccctgtgtatctaaagggaaggaagtgtcatattttaggaatttttcttaaccttagcaatgagagcctaaaatacatacatggattatttttcttctaggaagtaaatttcctgctgctttaaatgatatgtaaaatatcaataatttttacacttaagatgttggtaagacctagttttctaatctctctagcactgtgatgtctccttgtagataatctggaccttgcttagtcctttagttgggaaacagaatcagggcatagagcagaagagagcttgacactccatatggtcctggttctgctacccattagcgattagtgaggagacctttagggagtccactgtgccctgtgtgtcaccacattttcttctgtgaaatcaagattaaagaacagatgactttcaaggtctttttcagttttataactgtgagtctatgtattaggtatttattttcaacaaatgactttaaaatgtcgaatgcaaacc

SEQ ID NO: 31433 - DNA, 2542 bp, Homo sapiens
aagtggcccggccagcggcgcggcgtccggggaggaaatggatgctgtgctggcctgccggctccgggggcggggaaatcgagtagctgcactcaggccccgcccgagacccggagggagcgccgggccgtccccttttgccctcctttgcgctgggctgagcccagagccgagagcaggagtcggctctgagttccctgcttggtttttgggtggcagcagccagaggaggaatatggcgctcttaggcagccgagcggagctggaagcggacgaggacgttttcgaagatgccttggaaaccatctcaatatcttctcactcagatatggcaacaagcagccttcactttgcatcatgtgatacacaacaggcgcccagacagcgcggagcgtctactgtcagcagttcatcatcaaccaaggtggatctcaagagtggcctcgaagaatgtgctgtggcattgaacttatttctaagcaacaaatttacagacgccttagaattgcttcgcccctgggctaaggagagtatgtaccatgccttgggctacagtaccattgtggtgttgcaggctgtcctgaccttcgagcaacaggacatccagaacggcatttctgccatgaaggacgctttacaaacctgccaaaaatacaggaaaaaatacacagttgtagaatctttctcaagtcttctttctagaggatccctggagcaactgagtgaagaggaaatgcatgctgaaatctgttatgccgagtgtctcctacagaaagctgcactcacgtttgtgcaggatgaaaatatgatcaacttcatcaaaggtggactcaaaattagaacaagttaccaaatatataaagaatgtctttctatcctgcatgaaattcagaagaacaaacttcagcaggaattcttctatgagtttgaagggggtgtcaagcttggcagtggggcctttaatttgatgctgtcccttttaccagcaaggattatcagactactagaatttattggattttctgggaatagggagttgggcctcctgcagttacgtgaaggtgcttcaggaaggagcatgaggtctgcactgtgctgcttaaccatcttagcttttcatacttacatctccctaatacttggtacaggagaagtgaatgttgcggaagcagagcgtctcctggcacccttcctccagcagtttccaaatggctcactcgtgttgttttatcatgcccgaatagagttgctgaaagggaatcttgaagaggcacaagaagtatttcaaaaatgcatttcagttcaagaagaatggaaacagtttcaccatctctgctactgggagctaatgtggattaatgttttccaacaaaactggatgcaggcatattactattcagatctgctttgcaaagagagtaaatggtccaaggcaacttatgtgttcttgaaagcagcaattttgagtatgcttccagaggaggatgtagtagcaacgaatgagaatgtggtaactttattcagacaggtggacagcttgaagcagagaattgccgggaaatctatccctactgagaagtttgctgtgaggaaggctcggcgttactccgcctccttacctgcacctgtgaagctcatcttacctgccctggaaatgatgtatgtctggaatggtttttcaatagtgagcaaaagaaaagacctttctgaaaatctgttagtaactgttgaaaaagctgaggcagctttacaaagtcaaaattttaacagcttctctgtggatgatgagtgcttagtgaagttacttaaaggatgttgcctcaagaacttacagcggcccttgcaagctgaactatgttacaatcatgttgtggaaagtgaaaagctactgaagtatgaccactacctagtgccgttcactctatttgaattggcatctttgtataaaagccagggggaaattgacaaggccataaagttcctagaaactgcaaggaacaactacaaagattactccctggagtccagactacacttcagaattcaggcagctcttcacctctggagaaaaccttcctcagattgatcagaacttgaaggatggaatttttcctcaattagcatcggcatctgctatagattcaaccttatattaaagtggaaaaatgatcttgtgaataagagacaaaaaaacagtttttttggtcaatattttctatcatctgagagatttactgttggtctacataattttttttcctatggaatggcattctatattatctagaaaattcttatattttgcctcccccaaaagaatttcatattatttgaattagggggcgaagaagtcttttgaaagacttgcagatgcaatagtctaattagattatttatttttttaatgtgaaaattaatattgtttagcaaatagcttacaagttgagccaattttggatttgttgggtagttaaacttcagagatattttgttgcctgtatttaaatttcagaagataaataaatatcattgcatttaaaat

SEQ ID NO: 31434 - DNA, 927 bp, Homo sapiens
gcgctgggctgagcccagagccgagagcaggagtcggctctgagttccctgcttggtttttgggtggcagcagccagaggaggaatatggcgctcttaggcagccgagcggagctggaagcggacgaggacgttttcgaagatgccttggaaaccatctcaatatcttctcactcagatatggcaacaagcagccttcactttgcatcatgtgatacacaacaggcgcccagacagcgcggagcgtctactgtcagcagttcatcatcaaccaaggtggatctcaagagtggcctcgaagaatgtgctgtggcattgaacttatttctaagcaacaaatttacagacgccttagaattgcttcgcccctgggctaaggagagtatgtaccatgccttgggctacagtaccattgtggtgttgcaggctgtcctgaccttcgagcaacaggacatccagaacggcatttctgccatgaaggacgctttacaaacctgccaaaaatacaggaaaaaatacacagttgtagaatctttctcaagtcttctttctagaggatccctggagcaactgagtgaagaggaaatgcatgctgaaatctgttatgccgagtgtctcctacagaaagctgcactcacgtttgtgcagagaatgtctttctatcctgcatgaaattcagaagaacaaacttcagcaggaattcttctatgagtttgaagggggtgtcaagcttggcagtggggcctttaatttgatgctgtcccttttaccagcaaggattatcagactactagaatttattggattttctgggaatagggagttgggcctcctgcagttacgtgaaggtgcttcaggaaggagcatgaggtctgcactgtgctgcttaaccatcttagcttttcatacttacatctccctaatactt

SEQ ID NO: 31435 - DNA, 2395 bp, Homo sapiens
aggattgagggaagggaacccgcgccgccggaaggagccgctcgcttcacggcgctgggacccgggctggaaggcagggcatcagctatggaacaacctgggcaggatcccacctcagacgacgtcatggactcgttcctggaaaagttccagagccagccttaccgtggcggctttcatgaggaccagtgggagaaggaatttgaaaaggtccccctatttatgtcgagagcgccatcagaaattgatcccagggagaatcctgacttggcttgtctccagtcaattatttttgatgaggagcgttctccagaagaacaggccaagacctataaagatgagggcaatgattactttaaagaaaaagactacaagaaagctgtaatttcatacactgaaggcttaaagaagaaatgtgcagatcctgatttgaatgctgtcctttataccaaccgggcagcagcacagtactatctgggcaattttcgttctgctctcaatgatgtgacagctgccagaaagctaaaaccctgccacctcaaagcaataataagaggtgccttatgccatctggaactgaaacactttgccgaggccgtgaactggtgtgatgagggactgcaaatagatgccaaagagaagaagcttctggaaatgagggctaaagcagacaagctgaagcgaattgaacagagggatgtgaggaaagccaacttgaaagaaaagaaggagaggaatcagaatgaggctttactccaggccatcaaggctaggaatatcaggctctcagaagctgcctgtgaggatgaagattcagcctcagaaggtctaggtgagcttttcctggatggactcagcactgagaacccccatggagccaggctgagtctagatggccagggcaggctgagctggcctgtgctctttctgtacccagagtatgcccagtcggacttcatctctgcttttcatgaggactccaggtttattgatcatctaatggtgatgtttggtgaaacaccctcttgggacctagagcaaaaatattgccctgataatttggaggtctactttgaggatgaggacagggcagaactataccgggtgcctgccaagagcaccttgctacaggttctacagcaccagaggtactttgtaaaagccctgacaccagcatttttggtctgtgtaggatcctctcctttttgcaagaattttctccgggggagaaaggtgtaccagatacgatgactaagccagggcccctggatctcctcccttaccctcctctgctgggaacctagcacacctgaatcagctggacatactgctggagtccagtgctttctttccgtcaccctggggatagtccttcctggcatcgtggtgggggaggagcctctggcttccctaaactgcagcctctctggctggtcttcactttcctcagttgatataaaactctgggtcttggccatgatgtccttggactccatcgctaaagggaccatctgctgcagttaccacagcaactgacctgagcggcaccctggtctgtggagatggactcaggatccagtgacatgattctgaacttttgtggagtttgacaccttagagaagctacccctcaaactgcacatctacacacaaacaaacaatgcataggattccaaggctttaaagctgagagaccctggcctcaagttatttcatgcgcacagagggaagccatgtggggttgctgaagatgccttgaggtgaaatgggggcaggaaagccacatcttgctctgcatttataaagaccgtacaaactcagatccttggtacccctaaaaagattgccaattttcttcatctttgccatatggaggactgtgacagactttggacagtggcctcttgagttcctctgcagttttgacatttaggattttgtgtcttttaaactggaaaatcttctagcatgttgggttgttacagagtatatttttgtctgcagctgtttgttgccccattcctaagaggagtttatccatcctgacttgtagctgtgtgacttcttgcagtgcccccaccccatccccccgggagagtgtacttccctgctcccaatgcagagggatatgcacaggcatgagctgtcctgcgtctgacagaagcctgaagagtcatgtgtggttggcctgtgctcttccctctgctgtgagaacacatttcccacagaggagccgttccatggagccgagctacagcagctggcctgcagccactgagtgtcacagcaatgagagagcaatgtttgctgtagtaagcagtgagatttaggggttggttgttactatagcagagctaatacatgagtaaactgaagccagctgctgtccttaaaa

SEQ ID NO: 31436 - DNA, 2418 bp, Homo sapiens
tggctgcgaagggcgcgcacggctcctacctgaaggtggagagcgagctggagcgctgccgcgccgagggccactgggaccgcatgccggagctggtccggcagctgcagacgctgagcatgcccggcggcggaggtaacaggcgaggcagcccgagcgcagcgttcacctttccggacaccgatgactttgggaaattgctgctggctgaggccctcctggagcagtgtttgaaggagaaccatgccaaaataaaagactccatgcctttgctggagaagaatgagccgaagatgagcgaagccaaaaattatctaagcagtatccttaaccatgggaggctctcgccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaaggcctctctctggaacgcctacccaactccatcgcctcccgcttccgcctgacagagagggaggaggaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgcctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatgttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctga

SEQ ID NO: 31437 - DNA, 5157 bp, Homo sapiens
ggccaggggcgggtccgcagctggcggcgccggggcccggggcggaggctgtggcagcagctgcagcggcggcggcggcggcagcgccaggagctgctacagcagaggcggaggttgctcctgtacgcgtacgggccgctcggccggagccgcagcccggaggcgccgggcggtgcgctgggagctgctggtgctgctgctgctgctgctgcccaccctccgccgcccgggcccccgctgccgcccgggccccggctgccgtctgcgcccccgtcgaccccgcccgcgagtgcgccccagccaggacgccgcccccggccgggtctccacttcttggccgcaccttccatgacagcgcccgcgagaagatggctgcgaagggcgcgcacggctcctacctgaaggtggagagcgagctggagcgctgccgcgccgagggccactgggaccgcatgccggagctggtccggcagctgcagacgctgagcatgcccggcggcggaggtaacaggcgaggcagcccgagcgcagcgttcacctttccggacaccgatgactttgggaaattgctgctggctgaggccctcctggagcagtgtttgaaggagaaccatgccaaaataaaagactccatgcctttgctggagaagaatgagccgaagatgagcgaagccaaaaattatctaagcagtatccttaaccatgggaggctctcgccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaaggcctctctctggaacgcctacccaactccatcgcctcccgcttccgcctgacagagagggaggaggaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatgttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcctctgcagctgcagccctcgttctcttggctgggccaagagggccttcctggatttctttgttggtgccttgggaaacagtctgacttgaaccctaagtgcctttggagagttttgtggtgaccagacttgctccccaagagctgggcagcggggagcctcacagctgtccttcaccctcacccatgcctctggcttggagtctgggtggggggttctcactccccactctcagcacagtacagacttctggatctctctcaggtcttgcccagggcggtcacaatgtgaagaaactgcgggcaagtgggaagactatgagatttctgggttcccttctcagacttggagttagtagatgattcctgcattgcccctgcttgccctctgagaccagctgggccccaccttgctctttccccctgctaccaagtgcctttggggtctgaccaggggtactgagcaccggccctaacacttccatctccacccaccccatctccctggcgatgtgctccagcccaagcagcctccgtaggctttagatcctgtggttgctagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttctccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatatatataaaatagagatctattttttttctggaattctgttagaaaagtaaagaaaaagcaaatgctgttggtttatctcagggtgcccaaagtggttatagtcaatttttggtactaggaaaggcacccaatgcatttcctgacttttaagcatttccttgttggaagcagcagagggccaggccaagttgctgacagtgactttgcaggttgaataaagaaacccttggaggggaagcaggcttgtctgaagcagcatgtatattcactgggcatgtagctcccacaccagccttgagccaggccctggacaggaggggctgttgcaggatgagggaggccagagaaggcatcgaagccaagacctgggcccacctggggagggatgtgggaaaggaaggatgggagggaggaccctctgggaaaatgtggatttgagctggtgagagtgttgctaaggctgggctaaagcctggagagggtaggaggaggcaagaggggtccaggcagggctgatcctggcctctgacctgtccagggcgacccctgaagcccctgctgcctctgggcattgctgggagaggccaaggcaggactcacgtctgaacagagatcccctcgggcattgctgatgggccaccttcagctgcagggaagaagcctaggagaggaggcatgggagggacctgggccttgttcagattggccacctctgctgagaagtccataccagtacacccctaataagttatgccacataccaacgtactgtggatattataacctgcattaaaacaactctaaagaacgctgctcattt

SEQ ID NO: 31438 - DNA, 4270 bp, Homo sapiens
aagaaaaaaataaatttttttaaaaaacctcattctctttcgcttagaaaaaagagggaggaggaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatgttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcctctgcagctgcagccctcgttctcttggctgggccaagagggccttcctggatttctttgttggtgccttgggaaacagtctgacttgaaccctaagtgcctttggagagttttgtggtgaccagacttgctccccaagagctgggcagcggggagcctcacagctgtccttcaccctcacccatgcctctggcttggagtctgggtggggggttctcactccccactctcagcacagtacagacttctggatctctctcaggtcttgcccagggcggtcacaatgtgaagaaactgcgggcaagtgggaagactatgagatttctgggttcccttctcagacttggagttagtagatgattcctgcattgcccctgcttgccctctgagaccagctgggccccaccttgctctttccccctgctaccaagtgcctttggggtctgaccaggggtactgagcaccggccctaacacttccatctccacccaccccatctccctggcgatgtgctccagcccaagcagcctccgtaggctttagatcctgtggttgctagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttctccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatatatataaaatagagatctattttttttctggaattctgttagaaaagtaaagaaaaagcaaatgctgttggtttatctcagggtgcccaaagtggttatagtcaatttttggtactaggaaaggcacccaatgcatttcctgacttttaagcatttccttgttggaagcagcagagggccaggccaagttgctgacagtgactttgcaggttgaataaagaaacccttggaggggaagcaggcttgtctgaagcagcatgtatattcactgggcatgtagctcccacaccagccttgagccaggccctggacaggaggggctgttgcaggatgagggaggccagagaaggcatcgaagccaagacctgggcccacctggggagggatgtgggaaaggaaggatgggagggaggaccctctgggaaaatgtggatttgagctggtgagagtgttgctaaggctgggctaaagcctggagagggtaggaggaggcaagaggggtccaggcagggctgatcctggcctctgacctgtccagggcgacccctgaagcccctgctgcctctgggcattgctgggagaggccaaggcaggactcacgtctgaacagagatcccctcgggcattgctgatgggccaccttcagctgcagggaagaagcctaggagaggaggcatgggagggacctgggccttgttcagattggccacctctgctgagaagtccataccagtacacccctaataagttatgccacataccaacgtactgtggatattataacctgcattaaaacaactctaaagaacgctgctcattt

SEQ ID NO: 31439 - DNA, 697 bp, Homo sapiens
ggttgctcctgtacgcgtacgggccgctcggccggagccgcagcccggaggcgccgggcggtgcgctgggagctgctggtgctgctgctgctgctgctgcccaccctccgccgcccgggcccccgctgccgcccgggccccggctgccgtctgcgcccccgtcgaccccgcccgcgagtgcgccccagccaggacgccgcccccggccgggtctccacttcttggccgcaccttccatgacagcgcccgcgagaagatggctgcgaagggcgcgcacggctcctacctgaaggtggagagcgagctggagcgctgccgcgccgagggccactgggaccgcatgccggagctggtccggcagctgcagacgctgagcatgcccggcggcggaggtaacaggcgaggcagcccgagcgcagcgttcacctttccggacaccgatgactttgggaaattgctgctggctgaggccctcctggagcagtgtttgaaggagaaccatgccaaaataaaagactccatgcctttgctggagaagaatgagccgaagatgagcgaagccaaaaattatctaagcagtatccttaaccatgggaggctctcgggtctcgctgtgttactcaggctggtctccaactcctgggctcaagcgatcctcctacttcagcctcccgaagcgttgggattacaggagtga

SEQ ID NO: 31440 - DNA, 2226 bp, Homo sapiens
acgcccacctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggcttccatgcttacaagtcctgatggaccatttataaatttatctaggctgaatttaacaaagtattcccagaaacctaagttggcaaaggctttgtttgagtatatctttcatcatgaaaatgatgttaagactattcatcttgaagatgtagttctacatcttggaatttacccattcttattgaggaataaaaatcacattgaaaaaaatgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacacca

SEQ ID NO: 31441 - DNA, 2180 bp, Homo sapiens
aggacctcgagaaacagcggacaatttcaggatttaggactttaggtcttgatgggtggatggcgcgctgcgggcacctctcggacaaggccccagccgtcgcgggttgccgggcagagtcggacgccgccagctcttcactccacgcccacctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccagaaaattagctgggcgtggtggcacgtgcctgtaatcccagctacttgggaggctgaggcaggagaattgcttgaacccaggaagcggaggttgcagcaagccgagatcacgccattgtactccagcttgggcaacaagagcaaaactccatctcaaaaagcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggcttccatgcttacaagtcctgatggaccatttataaatttatctaggctgaatttaacaaagtattcccagaaacctaagttggcaaaggctttgtttgagtatatctttcatcatgaaaatgatgttaagactgctttggatctggctgccctctccacagaacattctcagtacaaggactggtggtggaaagtacagattggaaaataggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttt

SEQ ID NO: 31442 - DNA, 2183 bp, Homo sapiens
ggcagagtcggacgccgccagctcttcactccacgcccacctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggcttccatgcttacaagtcctgatggaccatttataaatttatctaggctgaatttaacaaagtattcccagaaacctaagttggcaaaggctttgtttgagtatatctttcatcatgaaaatgatgttaagactgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacaccatca

SEQ ID NO: 31443 - DNA, 2058 bp, Homo sapiens
acgcccacctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggctttgtttgagtatatctttcatcatgaaaatgatgttaagactgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacacca

SEQ ID NO: 31444 - DNA, 1342 bp, Homo sapiens
ccacctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcc

SEQ ID NO: 31445 - DNA, 1531 bp, Homo sapiens
atgattttgagttatgaagtaatattacacgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacacc

SEQ ID NO: 31446 - DNA, 2171 bp, Homo sapiens
acctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggaaccagatcctgaattgccagtgcatcaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggcttccatgcttacaagtcctgatggaccatttataaatttatctaggctgaatttaacaaagtattcccagaaacctaagttggcaaaggctttgtttgagtatatctttcatcatgaaaatgatgttaagactgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacacc

SEQ ID NO: 31447 - DNA, 2139 bp, Homo sapiens
gacgccgccagctcttcactccacgcccacctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggctttgtttgagtatatctttcatcatgaaaatgatgttaagactcaaaatccttttcttcaagtgaaatcttatcgagaccctaatacgtaaaacagacaaaaggctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacacc

SEQ ID NO: 31448 - DNA, 2665 bp, Homo sapiens
agcccagtaacaagatggatggggcagagaaggagccaacacagtcattttggtttggaattacaggctaatagattcattcatttcctgaagctgctgttggatctctcttcccctcccccaaggaggggactggctgtcggggctggatgcccagggagtgggcagtcccagggaaaatgagagtctaagccaggagaccttcgcagacttgaggggtccttccctggggcctgaagggggcagagtgcacgcaggccagggcctggactgatagtgccaggatgatgggtcatttgttctgggcagaccttttctgccttctcattagcctcaaaggagctgccaggaagcagctgtcattcagctcagaggcccagggtctgcctgtactgcacacagccctttccctcatctccctggtccagagcgggacaggcagctccttgagcatcactagtcctgggacccaccccagcagctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctggc

SEQ ID NO: 31449 - DNA, 345 bp, Homo sapiens
atgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggt

SEQ ID NO: 31450 - DNA, 3237 bp, Homo sapiens
ctctagccgccccactcgctgctctgcggggaggcgggcgctcccgcaggggttcctccaagatggcggcgcagaggaggagcttgctgcagagtgagcagcagccaagctggacagatgacctgcctctctgccacctctctggggttggctcagcctccaaccgcagctactctgctgatggcaagggcactgagagccacccgccagaggacagctggctcaagttcaggagtgagaacaactgcttcctgtatggggtcttcaacggctatgatggcaaccgagtgaccaacttcgtggcccagcggctgtccgcagagctcctgctgggccagctgaatgccgagcacgccgaggccgatgtgcggcgtgtgctgctgcaggccttcgatgtggtggagaggagcttcctggagtccattgacgacgccttggctgagaaggcaagcctccagtcgcaattgccagagggagtccctcagcaccagctgcctcctcagtatcagaagatccttgagagactcaagacgttagagagggaaatttcgggaggggccatggccgttgtggcggtccttctcaacaacaagctctacgtcgccaatgtcggtacaaaccgtgcacttttatgcaaatcgacagtggatgggttgcaggtgacacagctgaacgtggaccacaccacagagaacgaggatgagctcttccgtctttcgcagctgggcttggatgctggaaagatcaagcaggtggggatcatctgtgggcaggagagcacccggcggatcggggattacaaggttaaatatggctacacggacattgaccttctcagcgctgccaagtccaaaccaatcatcgcagagccagaaatccatggggcacagccgctggatggggtgacgggcttcttggtgctgatgtcggaggggttgtacaaggccctagaggcagcccatgggcctgggcaggccaaccaggagattgctgcgatgattgacactgagtttgccaagcagacctccctggacgcagtggcccaggccgtcgtggaccgggtgaagcgcatccacagcgacaccttcgccagtggtggggagcgtgccaggttctgcccccggcacgaggacatgaccctgctagtgaggaactttggctacccgctgggcgaaatgagccagcccacaccgagcccagccccagctgcaggaggacgagtgtaccctgtgtctgtgccatactccagcgcccagagcaccagcaagaccagcgtgaccctctcccttgtcatgccctcccagggccagatggtcaacggggctcacagtgcttccaccctggacgaagccacccccaccctcaccaaccaaagcccgaccttaaccctgcagtccaccaacacgcacacgcagagcagcagctccagctctgacggaggcctcttccgctcccggcccgcccactcgctcccgcctggcgaggacggtcgtgttgagccctatgtggactttgctgagttttaccgcctctggagcgtggaccatggcgagcagagcgtggtgacagcaccgtagggcagccggagaatgcagcccaagcagggcctggcatggggcaggacagggtccagccttttcctaacatctgcctgtgccacaacggccagcaggtgccccatcctctgcccacagcagactctgtcccatggctctccgggcagtagagtgtgtgagtgcagactggacctgtggttcataccttgtcaccacccgggaagctgaaggccacttcctcccagatggcctcagccaggaccatcgccctttctcagagcagagggccaggtatagaaaccgcagtgggcctgcaagccgcccgagcctccccagcagcctcctacagagcaggaagaggcgccctgtgaaccctgagtgttgcaggcccagcagaccctgctgtcccaagcccacccctcctcccaccatcacctccctcacctcgggacagtagccctccacttctccagcctctcagccctgtgctcctgcatccagagtggaacccaggctggtgtccgcatctgtccctgggccccacccctggacctgccttggttgtgtcatctgttgtaaacgttcaggaggaccagggcagcatctggggcctgggatggccacagaaggggcaggccaggtggaaaggagccagggggaagtggtctaagagacctggaactgccagaggatggcggcctgggcttccccagagccaggcgtgcgggagaggtgaggactggccccggtgggctgaggcaggggccgctgtcgtcaggcctgagccagggtgagctggtgcctgccttgcattttccttctggtgctgtgaagaccataggctggcaggcagctgagatgaactgtctttaccactgatgaggggcctctgccggctgagggtagcaagcaggggttgtgagtcaggctgggggacttgtttgaaagaaagaggagtggaaaatggttccaggagggaagaggttctttgagacacagtaccctgggaggcataggagaagggtcgggccagcccagcccagggcctgagttagactatttcccacatgttctctgccttcagtggggagggggtgccaccagggctgtcggccaggattgccactcctgtttcagaggaagcaggccgagagacttgcaccttggccaagccacacaatcagtggggcagccagagctcagacctgagccattttgtcagtatccaggaccccccggattctccacgccctccccatctcccagtctccctgccccccatgccccagaccggcccaccagggactagccgctgtcgcacagcctctggggtgcttggtctctgcgaagtcaaaggcctgacagctctgtggcctgggaatccattttcctgcggcagagcagggcctggtgtggaaccagggagctgtgggaagccacagcagaaatggaagaaaaacaggtctcagcccagggtcctcgctcactccctcactccccactttgaagccatctctgttctgcaggtgagaggatttaaagtcagtcacaaaggcttgggaacaaaaggaattctcttccaagaatgcctctgtggtgctgtttggtctctagaaacagggtcacttttttaatgtagtaaagaagtaataaatggtggcattacacattgtgatattaa

SEQ ID NO: 31451 - DNA, 1660 bp, Homo sapiens
ccgcaggggttcctccaagatggcggcgcagaggaggagcttgctgcagagtgagcagcagccaagctggacagatgacctgcctctctgccacctctctggggttggctcagcctccaaccgcagctactctgctgatggcaagggcactgagagccacccgccagaggacagctggctcaagttcaggagtgagaacaactgcttcctgtatggggtcttcaacggctatgatggcaaccgagtgaccaacttcgtggcccagcggctgtccgcagagctcctgctgggccagctgaatgccgagcacgccgaggccgatgtgcggcgtgtgctgctgcaggccttcgatgtggtggagaggagcttcctggagtccattgacgacgccttggctgagaaggcaagcctccagtcgcaattgccagagggagtccctcagcaccagctgcctcctcagtatcagaagatccttgagagactcaagacgttagagagggaaatttcgggaggggccatggccgttgtggcggtccttctcaacaacaagctctacgtcgccaatgtcggtacaaaccgtgcacttttatgcaaatcgacagtggatgggttgcaggtgacacagctgaacgtggaccacaccacagagaacgaggatgagctcttccgtctttcgcagctgggcttggatgctggaaagatcaagcaggtggggatcatctgtgggcaggagagcacccggcggatcggggattacaaggttaaatatggctacacggacattgaccttctcagcgctgccaagtccaaaccaatcatcgcagagccagaaatccatggggcacagccgctggatggggtgacgggcttcttggtgctgatgtcggaggggttgtacaaggccctagaggcagcccatgggcctgggcaggccaaccaggagattgctgcgatgattgacactgagtttgccaagcagacctccctggacgcagtggcccaggccgtcgtggaccgggtgaagcgcatccacagcgacaccttcgccagtggtggggagcgtgccaggttctgcccccggcacgaggacatgaccctgctagtgaggaactttggctacccgctgggcgaaatgagccagcccacaccgagcccagccccagctgcaggaggacgagtgtaccctgtgtctgtgccatactccagcgcccagagcaccagcaagaccagcgtgaccctctcccttgtcatgccctcccagggccagatggtcaacggggctcacagtgcttccaccctggacgaagccacccccaccctcaccaaagacccttccaggcctgcaagcgatttgacagccatccctcagtgccaactaaacctcctgggcagcctgaccccagggtaggaaggaagcgcctacaccaaggggccctctgggagctgagatcatcctggggttttgtcgcctggtctgacttgtgcactgggatcttctcgtgccaggccaggccccgccccctccccgggactgggcagaccccctccctcatgcatctgtgtccactgaggcttccctcacctagaatggcccatccttcaggacccagctcactctcatcttctttccagggacttatcccccaaggctgtcctctgt

SEQ ID NO: 31452 - DNA, 4058 bp, Homo sapiens
gaaaatgcttggacagaagagatgagtactatttccactaaggcctagaattgcctactgtacaaatagtcctgatcaggcaatatacgaatggcccaaggaagccaccaaattgattttcaggttttacatgacctgcgacaaaaattccctgaagtacctgaagttgttgtatccaggtgcatgttacagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaagctcttttggtacaccagaaggccagaatggaacgacttcaaagagaacttgagattcaaaagaaaaagctggataaattaaaatctgaggttaatgaaatggaaaataatctaactcgaaggcgcctgaaaagatcaaattctatatcccagataccttcccttgaagaaatgcagcagctgagaagttgtaatagacaactccagattgacattgactgcttaaccaaagaaattgatctttttcaagcccgaggaccacattttaaccccagcgctattcataacttttatgacaatattggatttgtaggtcctgtgccaccaaaacccaaagatcaaaggtccatcatcaaaacaccaaagactcaagacacagaagatgatgagggagctcagtggaattgtaccgcctgtacttttttgaaccatccagccttaattcgctgtgaacagtgtgagatgccaaggcatttctgagccaaatggccctgtatcttctctaaaaccacatctaaagttcaagaaactagtctgtcatcgggaaaaagtttcactgctacataggattttgtcaaattgaaggtgtgacaagatggtgttctgctaatgttaaatgtcagcccacagagctaataatacctcagtataatgtcatgagcagttgaaattcatcacatgaaaagtaatctgctgaaagacttggttgcccactgcctaactgtgtacagtgttaccagtgtcccattatggataattctcaatatgttaacacctaggtgttcccaatacctttttcccctcatgtcactactgaattttgacaggaggaaggaatagaatgatagcttgttttatttgtaaagctttcagtgaaacactacatacacgaagaaaaggaacaaggtttaactatttaagaaccatttgctgccgcatagtgccattggatagggaagaacttcagaaatctgtggtactcttggccttgtctttgtcttccctgaacgtgtctccactctgtgaagccagcatctaggggctaaagatgcaaaggaaagcagcatgcattgtctgtacaaatgtgcagcgaaataccccaaagcttttcctactgtacagatctctcgagtctgctttaagtgatttcttttcttcttgattattttcttatatttctatatgtatagtgtaatagccttttgttaactaattttcttttttccttttagtaattaagcacgatcatgtccctttttaagccttacctgagaggaacaatgccttaaaataaaaaagcattaatgagatgaaagtatgcacagaataactttcctctacttattctgtactttgccctcatgagttccaatgttgtgtgaagacaggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaaagcccttacgtttgatgcaatttatttttaaaataggccttgtttttcagcttcatctgcagttctatgtgaagattgataaatcagtttttacttgttttattaataaaacgtaatttggatatcttgagttgatggttttgtgatttagctgggtaaactatctttgtaacagataagttatttataaaaattaaaaaacttatattct

SEQ ID NO: 31453 - DNA, 4553 bp, Homo sapiens
gaaaagttttaggcagctaggaatgtggagatgtgggtagtggtggctgccaagcacaggaaaatgatcatgctgaactgtacaaaggagattgtctctgaaccttttcataggttctgacactctatatatgtcatcttatttaaaaccctctgtattaaaatgataaggatttggagacattgaaattatatagaatttaaatgtatgcatgttcatatgtttttgcctctggctcatatttccagaatacttaacagtattttaacattttgtttcttatgattctggtcctaaaaaatcaaggacgctgcttactcagaaagctaaaaaacctgagctccagacccagttcctggacctgccctggaaaagaagtatcccgtagagatgagctcactgcagttacttaattaacaatttgtaagctgcaaaaatggcaatgggccaaccaagaacagctacaatttgaatttttctatttccagaaaatgcttggacagaagagatgagtactatttccactaaggcctagaattgcctactgtacaaatagtcctgatcaggcaatatacgaatggcccaaggaagccaccaaattgattttcaggttttacatgacctgcgacaaaaattccctgaagtacctgaagttgttgtatccaggtgcatgttacagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaagctcttttggtacaccagaaggccagaatggaacgacttcaaagagaacttgagattcaaaagaaaaagctggataaattaaaatctgaggttaatgaaatggaaaataatctaactcgaaggcgcctgaaaagatcaaattctatatcccagataccttcccttgaagaaatgcagcagctgagaagttgtaatagacaactccagattgacattgactgcttaaccaaagaaattgatctttttcaagcccgaggaccacattttaaccccagcgctattcataacttttatgacaatattggatttgtaggtcctgtgccaccaaaacccaaagatcaaaggtccatcatcaaaacaccaaagactcaagacacagaagatgatgagggagctcagtggaattgtaccgcctgtacttttttgaaccatccagccttaattcgctgtgaacagtgtgagatgccaaggcatttctgagccaaatggccctgtatcttctctaaaaccacatctaaagttcaagaaactagtctgtcatcgggaaaaagtttcactgctacataggattttgtcaaattgaaggtgtgacaagatggtgttctgctaatgttaaatgtcagcccacagagctaataatacctcagtataatgtcatgagcagttgaaattcatcacatgaaaagtaatctgctgaaagacttggttgcccactgcctaactgtgtacagtgttaccagtgtcccattatggataattctcaatatgttaacacctaggtgttcccaatacctttttcccctcatgtcactactgaattttgacaggaggaaggaatagaatgatagcttgttttatttgtaaagctttcagtgaaacactacatacacgaagaaaaggaacaaggtttaactatttaagaaccatttgctgccgcatagtgccattggatagggaagaacttcagaaatctgtggtactcttggccttgtctttgtcttccctgaacgtgtctccactctgtgaagccagcatctaggggctaaagatgcaaaggaaagcagcatgcattgtctgtacaaatgtgcagcgaaataccccaaagcttttcctactgtacagatctctcgagtctgctttaagtgatttcttttcttcttgattattttcttatatttctatatgtatagtgtaatagccttttgttaactaattttcttttttccttttagtaattaagcacgatcatgtccctttttaagccttacctgagaggaacaatgccttaaaataaaaaagcattaatgagatgaaagtatgcacagaataactttcctctacttattctgtactttgccctcatgagttccaatgttgtgtgaagacaggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaaagcccttacgtttgatgcaatttatttttaaaataggccttgtttttcagcttcatctgcagttctatgtgaagattgataaatcagtttttacttgttttattaataaaacgtaatttggatatcttgagttgatggttttgtgatttagctgggtaaactatctttgtaacagataagttatttataaaaattaaaaaacttatattctaatgtgga

SEQ ID NO: 31454 - DNA, 1789 bp, Homo sapiens
ggaggcgacggtggagacggctgccctagtgggagaggcggcggcggcggcggccgaggaggaggagggggaagcggcggcggcaaaggaaaatgcttggacagaagagatgagtactatttccactaaggcctagaattgcctactgtacaaatagtcctgatcaggcaatatacgaatggcccaaggaagccaccaaattgattttcaggttttacatgacctgcgacaaaaattccctgaagtacctgaagttgttgtatccaggtgcatgttacagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaagatatttga

SEQ ID NO: 31455 - DNA, 2336 bp, Homo sapiens
agtgaggtgaactccttcagggccacaggctgtaaagatctaaacaccatctgatccagtttcaatatgactgcctggatgaagaaggatttgagactaagtttattcctccaaagcaaaccaactgagaatgcagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaagctcttttggtacaccagaaggccagaatggaacgacttcaaagagaacttgagattcaaaagaaaaagctggataaattaaaatctgaggttaatgaaatggaaaataatctaactcgaaggcgcctgaaaagatcaaattctatatcccagataccttcccttgaagaaatgcagcagctgagaagttgtaatagacaactccagattgacattgactgcttaaccaaagaaattgatctttttcaagcccgaggaccacattttaaccccagcgctattcataacttttatgacaatattggatttgtaggtcctgtgccaccaaaacccaaagatcaaaggtccatcatcaaaacaccaaagactcaagacacagaagatgatgagggagctcagtggaattgtaccgcctgtacttttttgaaccatccagccttaattcgctgtgaacagtgtgagatgccaaggcatttctgagccaaatggccctgtatcttctctaaaaccacatctaaagttcaagaaactagtctgtcatcgggaaaaagtttcactgctacataggattttgtcaaattgaaggtgtgacaagatggtgttctgctaatgttaaatgtcagcccacagagctaataatacctcagtataatgtcatgagcagttgaaattcatcacatgaaaagtaatctgctgaaag

SEQ ID NO: 31456 - DNA, 4380 bp, Homo sapiens
atcgagcgcctaggagagccccgggtgggggagggcgcaaggggctcgggagggcccctccctgcgtcggcgcccctgacccgcccccaggcatgtgtgaggtgggggcgggggaggaaaaatctccttttggctctagtttactctagtttctcttctgctttcaaggctccagacccagttcctggacctgccctggaaaagaagtatcccgtagagatgagctcactgcagttacttaattaacaatttgtaagctgcaaaaatggcaatgggccaaccaagaacagctacaatttgaatttttctatttccagaaaatgcttggacagaagagatgagtactatttccactaaggcctagaattgcctactgtacaaatagtcctgatcaggcaatatacgaatggcccaaggaagccaccaaattgattttcaggttttacatgacctgcgacaaaaattccctgaagtacctgaagttgttgtatccaggtgcatgttacagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaagctcttttggtacaccagaaggccagaatggaacgacttcaaagagaacttgagattcaaaagaaaaagctggataaattaaaatctgaggttaatgaaatggaaaataatctaactcgaaggcgcctgaaaagatcaaattctatatcccagataccttcccttgaagaaatgcagcagctgagaagttgtaatagacaactccagattgacattgactgcttaaccaaagaaattgatctttttcaagcccgaggaccacattttaaccccagcgctattcataacttttatgacaatattggatttgtaggtcctgtgccaccaaaacccaaagatcaaaggtccatcatcaaaacaccaaagactcaagacacagaagatgatgagggagctcagtggaattgtaccgcctgtacttttttgaaccatccagccttaattcgctgtgaacagtgtgagatgccaaggcatttctgagccaaatggccctgtatcttctctaaaaccacatctaaagttcaagaaactagtctgtcatcgggaaaaagtttcactgctacataggattttgtcaaattgaaggtgtgacaagatggtgttctgctaatgttaaatgtcagcccacagagctaataatacctcagtataatgtcatgagcagttgaaattcatcacatgaaaagtaatctgctgaaagacttggttgcccactgcctaactgtgtacagtgttaccagtgtcccattatggataattctcaatatgttaacacctaggtgttcccaatacctttttcccctcatgtcactactgaattttgacaggaggaaggaatagaatgatagcttgttttatttgtaaagctttcagtgaaacactacatacacgaagaaaaggaacaaggtttaactatttaagaaccatttgctgccgcatagtgccattggatagggaagaacttcagaaatctgtggtactcttggccttgtctttgtcttccctgaacgtgtctccactctgtgaagccagcatctaggggctaaagatgcaaaggaaagcagcatgcattgtctgtacaaatgtgcagcgaaataccccaaagcttttcctactgtacagatctctcgagtctgctttaagtgatttcttttcttcttgattattttcttatatttctatatgtatagtgtaatagccttttgttaactaattttcttttttccttttagtaattaagcacgatcatgtccctttttaagccttacctgagaggaacaatgccttaaaataaaaaagcattaatgagatgaaagtatgcacagaataactttcctctacttattctgtactttgccctcatgagttccaatgttgtgtgaagacaggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaaagcccttacgtttgatgcaatttatttttaaaataggccttgtttttcagcttcatctgcagttctatgtgaagattgataaatcagtttttacttgttttattaataaaacgtaatttggatatcttgagttgatggttttgtgatttagctgggtaaactatctttgtaacagataagttatttataaaaattaaaaaacttatattctaatgtg

SEQ ID NO: 31457 - DNA, 3613 bp, Homo sapiens
gtgctttccagccgcgagctgtcaggccgagtgtcaggccgggcaggtacgcggcgcgcgcccccggcgccccccgctccccgccgggacgccccgcgccgagccggaggccgcgtggacccgaaagccgctgggaaaagtttacccaaggtccagcctagcccctaggcaccatgtcggacagtgatctaggtgaggacgaaggcctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaaatatgtaactggttcatcaatgcccggcggcggcttctcccagacatgcttcggaaggatggcaaagaccctaatcagtttaccatttcccgccgcgggggtaaggcctcagatgtggccctcccccgtggcagcagcccctcagtgctggctgtgtctgtcccagcccccaccaatgtgctctccctgtctgtgtgctccatgccgcttcactcaggccagggggaaaagccagcagcccctttcccacgtggggagctggagtctcccaagcccctggtgacccctggtagcacacttactctgctgaccagggctgaggctggaagccccacaggtggactcttcaacacgccaccacccacacccccagagcaggacaaagaggacttcagcagcttccagctgctggtggaggtggcgctacagagggctgctgagatggagcttcagaagcagcaggacccatcactcccattactgcacactcccatccctttagtctctgaaaatccccagtaggcatctgccaagaagggtgctgaaggctccagccagctgtcctgggtttccgttttggttccctttcatacagagggttttctatggatcactgccaaacattgggatcatctcctctgtccagaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgctaaactgttttctttttcccttttttgctgtggtttgcattcacggcagtagttagcccaggtgtggggaacgagagtgcactgcatgatagcgttctggtgagctgggaaggacccaccactgccactgaggattgttttggaagaaaggaatatttttatcttggggaccagctaagtctctgcagtagtgtgaaattccaaatggttgttttatcattggtttggtttaccaaaaaaaaggcagggaaaaaaaaaaaaaacaaccgtatgagcgcattggcttgtctgccgcaggcacagaagggtagaaagccacagcagggggcagtccagcagactctgactcaactttctaggcacctagcagagaaagataagatcaaaaggtgtttggtttttcttttaatttttattgtagtttttttgggtgggtgggggaagtaaactagactgaagcgatggattttttttttcttttttttctttagtgtttttccctttgttcttgaacacttttgccctgcagcctcagttttgaattcttttagcaacttggattagaggggcccatatgtcagaagctcccagcacctcctacttgggagaaaagtgagccatctgctggtcaggaagtcctccagagaggcagcttttcccacaatggtggcaggaaactttggggaaagcaggaatggtgtccactgctgcggaggaactgccttcagagaaggtggggctggaaaagggttagaagcctcctagctgggattgtctttgtttcacctttctttaaattagaattacagaagcccctgcccagtgaacagataacgattggtcttatgctcctccctttcccccattttttcttttgctgttttgttttttgttttttgtttgtttgtttgtttttttgagacagagtcatgctctgtcacccgggctggagtgcagtggtgcgatctcagctcactgtaacctccgcctcccgggttcaagcaattatttgcctcagcctcccgagtagctgggattataggcacccgccaccatgtctggcttttagtagagacggggtttcaccatcttggccaggctggtcttggaactcctgacctcgtgagccaccacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtggatctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccctctccccgtgtgccccagggggatcagggatcctcaccctcctgaggcccagtggggaagaatgaacatggcttcatccaggttaactgatgctgccatttgcccagcctcttccatcccagccctgtcagtgagcccaggtctggtgcaactgctgcaggatgcctgtagtagggaactctggaagtgtattgggctgaggtgggattttccctccccacagtgcactgagcaatggagggtggtgagggagccatgctgctgaattctggttggcatttccccattatgtaaaatggggtgttgggtagggcagactctgcttgggtttggttgtaagataaacctggaggagaagcacagttgtcccattgaattatttgagcaaaaactactgtaaataacttttttgtcttttgtcaaataaaatttttttttgtttttttaagcagaaacagggttcttgattgatccaccagggctcagggcccaggcttgaagacaaagcagtcactggcttcttattttgctttacatcttttactctccctctagtagccagctgtgagttctgtgcacgctgtacccccattccctttcaccagctccattctgtatcccattcaactcagggtaaagggggcatttgcatctcacattgg

SEQ ID NO: 31458 - DNA, 3432 bp, Homo sapiens
gcggggggtgggcgcagctcgtcgcgctccgcacaaagtttgttttctccctccgggcgggtgggggagggcgcagagggcgcggggggaggagaggggatctgacgtcaggccgcgaggtgctttccagccgcgagctgtcaggccgagtgtcaggccgggcaggtttacccaaggtccagcctagcccctaggcaccatgtcggacagtgatctaggtgaggacgaaggcctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaaatatgtaactggttcatcaatgcccggcggcggcttctcccagacatgcttcggaaggatggcaaagaccctaatcagtttaccatttcccgccgcgggggtaaggcctcagatgtggccctcccccgtggcagcagcccctcagtgctggctgtgtctgtcccagcccccaccaatgtgctctccctgtctgtgtgctccatgccgcttcactcaggccagggggaaaagccagcagcccctttcccacgtggggagctggagtctcccaagcccctggtgacccctggtagcacacttactctgctgaccagggctgaggctggaagccccacaggtggactcttcaacacgccaccacccacacccccagagcaggacaaagaggacttcagcagcttccagctgctggtggaggtggcgctacagagggctgctgagatggagcttcagaagcagcaggacccatcactcccattactgcacactcccatccctttagtctctgaaaatccccagtaggcatctgccaagaagggtgctgaaggctccagccagctgtcctgggtttccgttttggttccctttcatacagagggttttctatggatcactgccaaacattgggatcatctcctctgtccagaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgctaaactgttttctttttcccttttttgctgtggtttgcattcacggcagtagttagcccaggtgtggggaacgagagtgcactgcatgatagcgttctggtgagctgggaaggacccaccactgccactgaggattgttttggaagaaaggaatatttttatcttggggaccagctaagtctctgcagtagtgtgaaattccaaatggttgttttatcattggtttggtttaccaaaaaaaaggcagggaaaaaaaaaaaaaacaaccgtatgagcgcattggcttgtctgccgcaggcacagaagggtagaaagccacagcagggggcagtccagcagactctgactcaactttctaggcacctagcagagaaagataagatcaaaaggtgtttggtttttcttttaatttttattgtagtttttttgggtgggtgggggaagtaaactagactgaagcgatggattttttttttcttttttttctttagtgtttttccctttgttcttgaacacttttgccctgcagcctcagttttgaattcttttagcaacttggattagaggggcccatatgtcagaagctcccagcacctcctacttgggagaaaagtgagccatctgctggtcaggaagtcctccagagaggcagcttttcccacaatggtggcaggaaactttggggaaagcaggaatggtgtccactgctgcggaggaactgccttcagagaaggtggggctggaaaagggttagaagcctcctagctgggattgtctttgtttcacctttctttaaattagaattacagaagcccctgcccagtgaacagataacgattggtcttatgctcctccctttcccccattttttcttttgctgttttgttttttgttttttgtttgtttgtttgtttttttgagacagagtcatgctctgtcacccgggctggagtgcagtggtgcgatctcagctcactgtaacctccgcctcccgggttcaagcaattatttgcctcagcctcccgagtagctgggattataggcacccgccaccatgtctggcttttagtagagacggggtttcaccatcttggccaggctggtcttggaactcctgacctcgtgagccaccacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtggatctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccctctccccgtgtgccccagggggatcagggatcctcaccctcctgaggcccagtggggaagaatgaacatggcttcatccaggttaactgatgctgccatttgcccagcctcttccatcccagccctgtcagtgagcccaggtctggtgcaactgctgcaggatgcctgtagtagggaactctggaagtgtattgggctgaggtgggattttccctccccacagtgcactgagcaatggagggtggtgagggagccatgctgctgaattctggttggcatttccccattatgtaaaatggggtgttgggtagggcagactctgcttgggtttggttgtaagataaacctggaggagaagcacagttgtcccattgaattatttgagcaaaaactactgtaaataacttttttgtcttttgtcaaataaaatttttttttgtttttttaagcagaaa

SEQ ID NO: 31459 - DNA, 638 bp, Homo sapiens
cccgcgccccgaagagtcggccagccccgaactgccggagtaggggtgggaaccaaactttttcctgccccgggacagacacgtttacccaaggtccagcctagcccctaggcaccatgtcggacagtgatctaggtgaggacgaaggcctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaaatatgtaactggttcatcaatgcccggcggcggcttctcccagacatgcttcggaaggatggcaaagaccctaatcagtttaccatttcccgccgcgggggtaaggcctcagatgtggccctcccccgtggcagcagcccctcagtgctggctgtgtctgtcccagcccccaccaatgtgctctccctgtctgtgtgctccatgccgcttcactcaggccagggggaaaagccagcagcccctttcccacgtggggagctggagtctcccaagcccctggtgacccctggtagcacacttactctgctgaccagggctgaggctggaagc

SEQ ID NO: 31460 - DNA, 923 bp, Homo sapiens
ggatggcgggcccgcgcgggagctggtgcgcggagtcggcccggggtgtggggactgtggggtgcaagcgccccgagcgccggacgattcctcgccgacccaggagccatgtgctccgactcggtctgggccgcgggggaggttgcgcgctttgtctgaactgctgggaatgcgggcgtttacccaaggtccagcctagcccctaggcaccatgtcggacagtgatctaggtgaggacgaaggcctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaaatatgtaactggttcatcaatgcccggcggcggcttctcccagacatgcttcggaaggatggcaaagaccctaatcagtttaccatttcccgccgcgggggtaaggcctcagatgtggccctcccccgtggcagcagcccctcagtgctggctgtgtctgtcccagcccccaccaatgtgctctccctgtctgtgtgctccatgccgcttcactcaggccagggggaaaagccagcagcccctttcccacgtggggagctggagtctcccaagcccctggtgacccctggtagcacacttactctgctgaccagggctgaggctggaagccccacaggtggactcttcaacacgccaccacccacacccccagagcaggacaaagaggacttcagcagcttccagctgctggtggaggtggcgctacagagggctgctgagatggagcttcagaagcagcaggacccatcactcccattactgcacactcccatccctttagtctctgaaaatccccagt

SEQ ID NO: 31461 - DNA, 1008 bp, Homo sapiens
aagaaaggatgtgacgtcactgagataaccagctcggctgttagcaactctgttagcaacgctgtttgtctttctcggaaacaacagtaacgataagcctcttggaatatggaggccgctgcggacggcccggctgagacccaaagcccggtggaaaaagacagcccggcgaagacccaaagcccagcccaagacacctcaatcatgtcgagaaataacgcagatacaggcagagttcttgccttaccagagcacaagaagaagcgcaagggaaacttgccagccgagtccgttaagatcctccgcgactggatgtataagcatcggtttaaggcctacccttcagaagaagagaagcaaatgctgtcagagaagaccaatttgtctttgttgcagatttctaactggtttatcaatgctcgcagacgcattctcccggatatgcttcaacagcgtagaaacgaccccatcattggccacaaaacgggcaaagatgcccatgccacccacctgcagagcaccgaggcgtctgtgccggccaagtcagggcccagtggtccagacaatgtacaaagcctgcccctgtggcccttgccaaagggccagatgtcaagagagaagcaaccagatccggagtcggcccctagccagaagctcaccggaatagcccagccgaagaaaaaggtcaaggtttctgtcacatccccgtcttctccagaacttgtgtctccagaggagcacgccgacttcagcagcttcctgctgctagtcgatgcagcagtacaaagggctgccgagctggagctagagaagaagcaagagcctaatccatgattgatgatgttccaaaaacccaagtagtcagtcccttatgtactgtggtaaacctgtttatgttcaccccaacttatttgtatgcttatcttttatagaggcatctttctttctagtggttttatgagaaccaatcttaattattgggactaaattctgtcagatatttcagtg

SEQ ID NO: 31462 - DNA, 856 bp, Homo sapiens
tcggaaacaacaggtgagaattccccttacagacctgcccatgctttctaaagtggctctcccaaacctacctttgtcctaactcagttgtctgtgattctcaatatagtaacgataagcctcttggaatatggaggccgctgcggacggcccggctgagacccaaagcccggtggaaaaagacagcccggcgaagacccaaagcccagcccaagacacctcaatcatgtcgagaaataacgcagatacaggcagagttcttgccttaccagagcacaagaagaagcgcaagggaaacttgccagccgagtccgttaagatcctccgcgactggatgtataagcatcggtttaaggcctacccttcagaagaagagaagcaaatgctgtcagagaagaccaatttgtctttgttgcagatttctaactggtttatcaatgctcgcagacgcattctcccggatatgcttcaacagcgtagaaacgaccccatcattggccacaaaacgggcaaagatgcccatgccacccacctgcagagcaccgaggcgtctgtgccggccaagtcagggcccagtggtccagacaatgtacaaagcctgcccctgtggcccttgccaaagggccagatgtcaagagagaagcaaccagatccggagtcggcccctagccagaagctcaccggaatagcccagccgaagaaaaaggtcaaggtttctgtcacatccccgtcttctccagaacttgtgtctccagaggagcacgccgacttcagcagcttcctgctgctagtcgatgcagcagtacaaagggctgccgagctggagctagagaagaagcaagagcctaatccatga

SEQ ID NO: 31463 - DNA, 905 bp, Homo sapiens
aagaaaggatgtgacgtcactgagataaccagctcggctgttagcaactctgttagcaaagctgtttgtctttctcggaaacaacagtaacgataagcctctttgaatatggaggccgctgcagacggcccggctgagacccaaagcccggtggaaaaagacagcccggcgaagacccaaagcccagcccaagacacctcaatcatgtcgagaaataacgcagatacaggcagagttcttgccttaccagagcacaagaagaagcgcaagggaaacttgccagccgagtccgttaagatcctccgcgactggatgtataagcatcggtttaaggcctacccttcagaagaagagaagcaaatgctgtcagagaagaccaatttgtctttgttgcggatttctaactggtttatcaatgctcgcagacgcattctcccggatatgcttcaacagcgtagaaacgaccccatcattggccacaaaacgggcaaagatgcccatgccacccacctgcagagcaccgaggcgtctgtgccggccaagtcagggccagtggtccagacaatgtacaaagcctgcccctgtggcccttgccaaagggccagatgtcaagagagaagcaaccagatccggagtcggcccctagccagaagctcaccggaatagcccagccaaagaaaaaggtcaagatttctatcacttccccgtcttctccagaacttgtgtctccagaggagtacgccgacttcagcagcttcctgctgctagtcgatgcagcagtacaaacggctgccgagctggagctagagaagaagcaagagcctaatccatgattgatgatgttccaaaaacccaagtagtcagtcccttgtgtactgtggtaaacctgtttatgttcaccccaa

SEQ ID NO: 31464 - DNA, 855 bp, Homo sapiens
tcggaaacaacaggtgagaattccccttacagacctgcccatgctttctaaagtggctctcccaaacctacctttgtcctaactcagttgtctgtgattctcaatatagtaacgataagcctctttgaatatggaggccgctgcagacggcccggctgagacccaaagcccggtggaaaaagacagcccggcgaagacccaaagcccagcccaagacacctcaatcatgtcgagaaataacgcagatacaggcagagttcttgccttaccagagcacaagaagaagcgcaagggaaacttgccagccgagtccgttaagatcctccgcgactggatgtataagcatcggtttaaggcctacccttcagaagaagagaagcaaatgctgtcagagaagaccaatttgtctttgttgcggatttctaactggtttatcaatgctcgcagacgcattctcccggatatgcttcaacagcgtagaaacgaccccatcattggccacaaaacgggcaaagatgcccatgccacccacctgcagagcaccgaggcgtctgtgccggccaagtcagggccagtggtccagacaatgtacaaagcctgcccctgtggcccttgccaaagggccagatgtcaagagagaagcaaccagatccggagtcggcccctagccagaagctcaccggaatagcccagccaaagaaaaaggtcaagatttctatcacttccccgtcttctccagaacttgtgtctccagaggagtacgccgacttcagcagcttcctgctgctagtcgatgcagcagtacaaacggctgccgagctggagctagagaagaagcaagagcctaatccatga

SEQ ID NO: 31465 - DNA, 2272 bp, Homo sapiens
gtccccgcctcgcgcatgcgccgcgctcgctcgcgggagggcatggcgggggccgtgccgggcgccatcatggacgaggactactacgggagcgcggccgagtggggcgacgaggctgacggcggccagcaggaggatgattctggagaaggagaggatgatgcggaggttcagcaagaatgcctgcataaattttccacccgggattatatcatggaaccctccatcttcaacactctgaagaggtattttcaggcaggagggtctccagagaatgttatccagctcttatctgaaaactacaccgctgtggcccagactgtgaacctgctggccgagtggctcattcagacaggtgttgagccagtgcaggttcaggaaactgtggaaaatcacttgaagagtttgctgatcaaacattttgacccccgcaaagcagattctatttttactgaagaaggagagaccccagcgtggctggaacagatgattgcacataccacgtggcgggaccttttttataaactggctgaagcccatccagactgtttgatgctgaacttcaccgttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaa

SEQ ID NO: 31466 - DNA, 2137 bp, Homo sapiens
gggagggcatggcgggggccgtgccgggcgccatcatggacgaggactactacgggagcgcggccgagtggggcgacgaggctgacggcggccagcaggaggatgattctggagaaggagaggatgatgcggaggttcagcaagaatgcctgcataaattttccacccgggattatatcatggaaccctccatcttcaacactctgaagaggtattttcaggcaggagggtctccagagaatgttatccagctcttatctgaaaactacaccgctgtggcccagactgtgaacctgctggccgagtggctcattcagacaggtgttgagccagtgcaggttcaggaaactgtggaaaatcacttgaagagtttgctgatcaaacattttgacccccgcaaagcagattctatttttactgaagaaggagagaccccagcgtggctggaacagatgattgcacataccacgtggcgggaccttttttataaactggctgaagcccatccagactgtttgatgctgaacttcaccgttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaa

SEQ ID NO: 31467 - DNA, 2399 bp, Homo sapiens
accatggaaacgaccatttccggtctggacctctcccgaatcgatagagccacacagtcgttgcagcttctagttgtattcgtgagagcccagtgcgtcaccacttcctcgttctattttcccagcctcataaaaacagagcgggagtattgggaggaggataagctggggaagaggctggccacactggttgctataaccaccaccacttccggtccgttcctctttacggcccacctcagcgctgcccgcgcgaaatttgtatccctctgcttgtgtccactggctcctggggagcagcgcagggaggaggaggaggaagatatcaaagagccctcccattgggggccccagatcgccacttccggtgaccagaggtagggaaggaaacaatcccgacccggagtggacaggtgaggaggggaggacttgcctcgccgaggccgctgcgaggagcgtgcccaagggcgaaggtccagggaacccggctcccgcgcaccgaagacggccgccatgccggcccgttgtgtggccgcccactgcggcaacaccaccaagtctgggaagtcgctgttccgctttcccaaggaccgggccgtgcggctgctctgggaccgcttcgtgcggggttgccgcgccgactggtacggaggcaatgaccgctcggtcatctgctctgaccactttgccccagcctgttttgacgtctcttcggttatccagaagaacctgcgcttctcccagcgcctgaggctggtggcaggcgccgtgcccaccctgcaccgggtgcccgccccggcacctaagaggggagaggagggagaccaagcaggccgcctggacacgcgaggagagctccaggcagccaggcattctgaggctgccccaggtccagtctcctgtacacgcccccgagctgggaagcaggctgcagcttcacagattacgtgtgaaaatgaacttgtgcaaacccaaccccatgctgataatccatctaatactgtcacttcagtacctactcactgtgaagaaggcccagtgcataaaagtacacaaatttctttgaaaaggccccgtcaccgtagtgtgggtattcaagccaaagtgaaagcgtttggaaaaagactgtgtaatgcaactactcagacagaggaattgtggtctagaacttcctctctctttgacatttactccagtgattcagaaacagatacagactgggatatcaagagtgaacagagtgatttgtcttatatggctgtacaggtgaaagaagaaacatgttaaaaactcaacatcaaatgctctgatgtgctatagattttcaaatctttactcacataattatctctttgctattgtaaatctttcacttcaagataatttgacagttgagtatcagcataatttgtttagctctaaggcaaaagtttgcttgcttgccaacacaatgaagataatacctacccacaaacatccctattctctactttcacctttttttttcttttaatccttttggtagaaatcaggttacaaagcaaaaccacaatatcagcaacacttcctaatcaaaattaagcattgaatatttgtttaagcttagttcagaagcaacgctcctacaggacttgacatttgctagttagaatatccctactcttctaaataatttgaaagtatagagcagtaacacagtaacagtgagcacagccaagcctgacactactaaatgatttggtagtgaagccaggacatctacccttgactattttttatgttatttatttattagtttgtccatttgtaacatgtatagatctgtcctgtgagcatttctgatgaatctatggttcttacagaaatttttcaaaggaatcaatttagagatagagttttcatatacttacattaacttattaatgaaatctgtttgcatcagtgcttactgcgacacattaattagcttgattaatttagattagaatcattaacatcatgaaaaataaaagtactacatttctaacgtattcccattgcaggtgttaggtattttttctgtcaacacctctcttttgaattctacatttgagaaataagcatggaaatattagctgccccgtctgccattcaccaggaaaaatttctatggcaattttgtaccatgaagtaaactgttacaatagtttctgagaagcatactataactctgatcttccattgagaataacaaaaataaatatcaattttacacctcatatgtcttcttagttctgaatgattagaagaacttgcatgtatttttatcctagaaggtttaaataatacatcaaagttattttcttccaaatgtaattttatgtctgctttaaggaaaataaaataaaatattaatagga

SEQ ID NO: 31468 - DNA, 785 bp, Homo sapiens
gagccaggtgcaaacatttcccgtcaattggcagaaaacaaccttgaggaaccttgacgagtgtccggagtttagaaaacttagggatggagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttatttttatggctgaggattttgaatatta

SEQ ID NO: 31469 - DNA, 2367 bp, Homo sapiens
ggtggcgcttcctcctcttagaggacccaggagcagttgtcgaggcggcagaggcgagctctgtccccgtccgagcagccatcttgcggtacggacgtgctcggcgcgcccatgtcgcggtacggacttgccccgccggggcgactcccccgcccgtctgcccgcctgccgacggacgctgcgaggggcctgcggcgccccgctggtccgaagacgcccgaacccgcggctggcgaggacgcgggcgggggctggggcgggggcgggcccgctgcgggcgcctgcgcctccatcttgccgtacggcgcggacgccgcgggccggcccacgtcccgagccgtgtcgccgccgcgctccctccctcggggcggtccgcgggcgggcgggcggctagggccggggcctggctgcgcggctgggccaaggcccgcgatggtgatctgctgtgcggccgtgaactgctccaaccggcagggaaagggcgagaagcgcgccgtctccttccacaggttccccctaaaggactcaaaacgtctaatccaatggttaaaagctgttcagagggataactggactcccactaagtattcatttctctgtagtgagcatttcaccaaagacagcttctccaagaggctggaggaccagcatcgcctgctgaagcccacggccgtgccatccatcttccacctgaccgagaagaagaggggggctggaggccatggccgcacccggagaaaagatgccagcaaggccacagggggtgtgaggggacactcgagtgccgccaccagcagaggagctgcaggttggtcaccgtcctcgagtggaaacccgatggccaagccagagtcccgcaggttgaagcaagctgctctgcaaggtgaagccacacccagggcggcccaggaggccgccagccaggagcaggcccagcaagctctggaacggactccaggagatggactggccaccatggtggcaggcagtcagggaaaagcagaagcgtctgccacagatgctggcgatgagagcgccacttcctccatcgaagggggcgtgacagataagagtggcatttctatggatgactttacgcccccaggatctggggcgtgcaaatttatcggctcacttcattcgtacagtttctcctctaagcacacccgagaaaggccatctgtcccccgagagcccattgaccgcaagaggctgaagaaagatgtggaaccaagctgcagtgggagcagcctgggacccgacaagggcctggcccagagccctcccagctcatcacttaccgcgacaccgcagaagccttcccagagcccctctgcccctcctgccgacgtcaccccaaagccagccacggaagccgtgcagagcgagcacagcgacgccagccccatgtccatcaacgaggtcatcctgtcggcgtcaggggcctgcaagctcatcgactcactgcactcctactgcttctcctcccggcagaacaagagccaggtgtgctgcctgcgggagcaggtggagaagaagaacggcgagctgaagagcctgcggcagagggtcagccgctccgacagccaggtgcggaagctacaggagaagctggatgagctgaggagagtgagcgtcccctatccaagtagcctgctgtcgcccagccgcgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttatttttatggctgaggattttgaatatta

SEQ ID NO: 31470 - DNA, 969 bp, Homo sapiens
gtggaaccaagctgcagtgggagcagcctgggacccgacaagggcctggcccagagccctcccagctcatcacttaccgcgacaccgcagaagccttcccagagcccctctgcccctcctgccgacgtcaccccaaagccagccacggaagccgtgcagagcgagcacagcgacgccagccccatgtccatcaacgaggtcatcctgtcggcgtcaggggcctgcaagctcatcgactcactgcactcctactgcttctcctcccggcagaacaagagccaggtgtgctgcctgcgggagcaggtggagaagaagaacggcgagctgaagagcctgcggcagagggtcagccgctccgacagccaggtgcggaagctacaggagaagctggatgagctgaggagagtgagcgtcccctatccaagtagcctgctgtcgcccagccgcgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttattttt

SEQ ID NO: 31471 - DNA, 1568 bp, Homo sapiens
gtgaggccttggacctgtggcctttgggcttgggtgtctcctgtccgctctgccagtgagtcctcagctctccgtacgtggcccgtcgcccgcggcaagacggagggaaggcgctagttcagtttagctagcaatgcccttcttgcgcgaggactgctggctggtggcgaggcccaggagcctgtttgggtgttaacagttaaaacagtaaagtttgcgcgggcttctgtggttttcagtcttttccccacttcacgtgatctcatttcattgaacaacattaaccaccatttaagatacgtgaaacctgcgaagtggaaaggtgcacgcaaagttaatttacaccccccgcgagatttcctctacatgacaaagaaagactggaaaagtggttaaagaatatgaagcgagattcatgggttcccagtaaataccagtttctatgtagtgaccattttactcctgactctcttgacatcagatggggtattcgatatttaaaacaaactgcagttccaacaatattttctttgcctgaagacaatcagggaaaagacccttctaaaaaaaaatcccagaagaaaaacttggaagatgagaaagaagtatgcccaaaagccaagtcagaagaatcatttgtattaaatgagacaaagaaaaatatagttaacacagatgtgccccatcaacatccagaattacttcattcatcttccttggtaaagccaccagctcccaaaacaggaagtatacaaaataacatgttaactcttaatctagttaaacaacatactgggaaaccagaatctaccttggaaacatcagttaaccaagatacaggtagaggtggttttcacacatgttttgagaatctaaattctacaactattactttgacaacttcaaattcagaaagtattcatcaatctttggaaactcaagaagttcttgaagtaactaccagtcatcttgctaatccaaactttacaagtaattccatggaaataaagtcagcacaggaaaatccattcttattcagcacaattaatcaaacagttgaagaattaaacacaaataaagaatctgttattgccatttttgtacctgctgaaaattctaaaccctcagttaattcttttatatctgcacaaaaagaaaccacggaaatggaagacacagacattgaagactccttgtataaggatgtagactatgggacagaagttttacaaatcgaacattcttactgcagacaagatataaataaggaacatctttggcagaaagtctctaagctacattcaaagataactcttctagagttaaaagagcaacaaactctaggtagattgaagtctttggaagctcttataaggcagctaaagcaggaaaactggctatctgaagaaaacgtcaagattatagaaaaccattttacaacatatgaagtcactatgatatagaataactaggttttaaaactatggctgttaaataagctttttccagccaaaccaaactacatgtaaagtgaactgtttcctgtataaagttctcatcttaatgaa

SEQ ID NO: 31472 - DNA, 3018 bp, Homo sapiens
ggcggaagtgagtcgacagacgaggcggctttcccggcagaatgctagcgcaggcgcaggggctcgagaggcctggacctgtggcgcatcctcagtgaggagggccgccctgcatccgtcgccggccccggtctccaggggcctcacccgagtcatgccccgctattgcgcagcgatttgttgtaagaaccgccggggacgaaacaataaagaccggaagctgagtttttatccatttcctctacatgacaaagaaagactggaaaagtggttaaagaatatgaagcgagattcatgggttcccagtaaataccagtttctatgtagtgaccattttactcctgactctcttgacatcagatggggtattcgatatttaaaacaaactgcagttccaacaatattttctttgcctgaagacaatcagggaaaagacccttctaaaaaaaaatcccagaagaaaaacttggaagatgagaaagaagtatgcccaaaagccaagtcagaagaatcatttgtattaaatgagacaaagaaaaatatagttaacacagatgtgccccatcaacatccagaattacttcattcatcttccttggtaaagccaccagctcccaaaacaggaagtatacaaaataacatgttaactcttaatctagttaaacaacatactgggaaaccagaatctaccttggaaacatcagttaaccaagatacaggtagaggtggttttcacacatgttttgagaatctaaattctacaactattactttgacaacttcaaattcagaaagtattcatcaatctttggaaactcaagaagttcttgaagtaactaccagtcatcttgctaatccaaactttacaagtaattccatggaaataaagtcagcacaggaaaatccattcttattcagcacaattaatcaaacagttgaagaattaaacacaaataaagaatctgttattgccatttttgtacctgctgaaaattctaaaccctcagttaattcttttatatctgcacaaaaagaaaccacggaaatggaagacacagacattgaagactccttgtataaggatgtagactatgggacagaagttttacaaatcgaacattcttactgcagacaagatataaataaggaacatctttggcagaaagtctctaagctacattcaaagataactcttctagagttaaaagagcaacaaactctaggtagattgaagtctttggaagctcttataaggcagctaaagcaggaaaactggctatctgaagaaaacgtcaagattatagaaaaccattttacaacatatgaagtcactatgatatagaataactaggttttaaaactatggctgttaaataagctttttccagccaaaccaaactacatgtaaagtgaactgtttcctgtataaagttctcatcttaatgaacctatgagagtgttgtaaagttatgaactgtatcctattcttgtaatacttatttaagaaaaaccagagagttgggctggagagaaaagcagttttattacttgataattttccaaattaaaatttagcacatagaaggattcagttataacatgagaaaacaaagaagtgttcaaagagcacagactagaagtcaggttcaggaatcagtcctggttctaccactggcatatgacttgggcaagttacttatgattgtgcctcagtccctaatttgtaaaataagcacttactggatttgtaattggttatttatagtcccttccctttttattaagataattctattagaacacattttctgtaagataatatatacgtaatactagaagttggctagaatttgatgatattaaccatgtattattttcagtatttattgaattctgtggtctttgaccttttggctatagttacatattacagttatattatctgtaatagaaaggaagataaacttttttttttttttttttttttttttttttgagatggagtctcactctgtaacccaggctggagtgcagtggcctgatcttggctcactgcagcctctgcctcccgggttcaagtgattcttctgcctcagcttcccgagtagctgggattataggcacacaccaccacatccagcttatttttgtatttttagtagaaacggggtttcaccatgttggccgggctggcctcgaactcctgaccccaggtgatccacctaccttggcctcccaaagtgctgggattacaggcgtgagccaccgcgcctggccaagatagaacttttataattttattccagttgaactaaactaaggaaccacccattagcccagttcttaggagaggtacttcaaacttgaaagaatatgtatttcggtaacttatatgtggctaaccatcaaatacatagtcatctaagctaaactttctgtatttatacagttaaacttataaaccaaaaattttaatgaggttaattttaaatatattttagaaattacagtttgtatctgtttcttagtaggtgtggcctttaaaatatgtgcttattcattgttaaattccagaataatagagtaatacttaatactgtacattcccacttacgtatattttattaaaatttataagcaagaaattatacataagtggtcatgatcttagggagacaaagaatttctcttagaaaagagaagtaatggtaatgtaaataaaaatactgtttatattcacatgattttaagaaaactgtaaaagcaaagattttgtagtaatgacacaaatgtaacaaatagatgttttcttaaaattggcagtcagtataattatgtttctgcctatgatgttgaggaagttgtatcagtctgattcttagttttttcatctgttaagtagaacgtactattacttaccttaaagagtggctttgagaattttgtaaggaacaaacatgtttttggttctggaatataggaggtgctcaataaaagttgactctgactggcaaataa

SEQ ID NO: 31473 - DNA, 3549 bp, Homo sapiens
agacgcagtctccgtcgttgacgttagtcgcagtcttcgctgctaacgttttgttatgagttgctaaaatggtgaaatgctgctccgccattggatgtgcttctcgctgcttgccaaattcgaagttaaaaggactgacatttcacgtattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactgaaacctggagtcataccttctatctttgattctccatatcacctacaggggaaaagagaaaaacttcattgtagaaaaaacttcaccctcaaaaccgttccagccactaactacaatcaccatcttgttggtgcttcctcatgtattgaagaattccaatcccagttcatttttgaacatagctacagtgtaatggacagtccaaagaaacttaagcataaattagatcatgtgatcggcgagctagaggatacaaaggaaagtctacggaatgttttagaccgagaaaaacgttttcagaaatcattgaggaagacaatcagggaattaaaggatgaatgtctgatcagccaagaaacagcaaatagactggacactttctgttgggactgttgtcaggagagcatagaacaggactatatttcatgaaataatttcatgttacgttccacctaaaattgtcattggtacaaatttttataaaatctcatttaccatcactaaataatatccatcatttaaagtgctgctttggattctctggagcattatgcattatagttgttatccaaagacttttttgaaaatatgcagaaatttgtggtaattatgtatttgtgtcttgtgacaattatgttttatagacctacactagtgccaggtcactattgtaagatgttaaaatctcaagaaaatttcacagagctaaagaaatgatgtcaaattagtcacattaagctatagtagaaggaattggacacttctccagatatttggcttcaaaggagtacctttacttacatgtgctttatggtaagtacattgaattttactttaaatgcattttactacaaagcacaattcatttgtaatgcatatccatcttggattcaatccaaggtgctttagctatcagtagtaccaaaggatctttttacaaggcttcctgtggtattgactctgagaataacacatagtgaagatctgtgggcttttaaaattgttcacagccaatttaagaagacccctcatgaagtctcagttttcagtacagtacatcattcctcctcactaggagcactttgatgtaaaccagaatagctttaaaaagacaaaaaggatcgtagatctgatttttaaatggttggttgctctgacagatctgaacactttgcttcatgactatttcgtcataaaggtatatgtttaaaatctgaatggcagtactagctctatacttttaatactgctttgtattttatatgtaaagtagtattgctgacattttaaaaaaatacaaaatacaaaagaaaccattagaaattaataactgtggctcttccagttgaaataggaattggagagaaaggattagaatattttaattaggggagtagattattgtccaaaggcttttatttagagaaacgggtaattaaaacagcagctttagaatagcttcttactgaatatgcaaaagaataattccttgttatttcctaattgatccaagtctcataaatttagcttttgtcataattccttaccgaaaacaactgaaattgagagtcataaatactgtgggttagaataaaaaccatttgccaaagcaacactctacttagaagcacatgtacatacatggacctcattcagaagtccatgttgtagcagttagaatttgagtatcagccatttcattgtagtaacaaaaattgaattgcattttgtgctcagttgtttattgtaattttatttttgttacattaatattagttaagatatggtcacttgaattttttgtatttaagaattttctgttttaatgcatgttatacttttatgtaggattccaaaccttccctctaaatgggatttaacccacatctgcgagatcagcgttatgctaagaggaaatcactgaggccatatctttttacaatctgaaaaaaaagtagtaaaaaggtagttaaaaaaaaaaaaggccgggtggtggctcatacctgtaatcctagcactttgggaggccaaggcaggcagatcacttgaggtcaggggttcaaaaccagcctggccaagatggtgaaaccccatctctgctaaaaatacaaaaaaaaattagccgggcatggtggcacgtgcctgtaatcccagctacttgggagactgaggcaggagaattgcttgaacccgggaggcggagattgcagtgagccaagatcacgccgttgcactccagcctgagcaacagagcaagactccatctcaaaaaaacaaaactactttcattaattacccattatttattttagttacttaattttgagttcataaatggccaccctaatggaaagtttgggtatgatcttaggttttatggagatgttttcaatagagattatttttccctcaccctatttgtgaatatataaattaaagtaagacaatggagtaagtaagagggtagatccaaacacagtatgtctaaattctagcactctactggctgcttagaatacaccaaacctggaagacctttccaagagtaaaatcccagtctgccactatcaaaattgccacagtcacttttactacttgtgttcatagtagactcagcacttctttttcactggacctagtataactgagaaataaataactgtgtgcaaaatattggtatcattaaggacccagagctgcccattttctctttgttctaatagggaagcaattactgatagaaatgtgagattaaaaatagggtcctccctgctgctccaaacaaatgcctaaacacagtatgtatctcagtcctctgttcccagagattccaccctagcccaggaaagaactggcctgtgtaaagcaaaacccaagtcatccccctccagaaatttctctggcagccaagcctgaccctaagggttccactttgctttaaaagctaggagtggcctctagagccaggaacacattaatacaacagttcaacctcagcaccaagtcaggtacgaagcgcttgatacgtggaatttttctctatatcaagtttaaatttctggaaatagactttggttgctaatgacaattacagttataccatagtctgtaatttgagaaaaggtgaaatgtatttaatatatatttagttttaataaaaagataaaattattacagaaataattgagagagagaaaatctattataatttatttgaaaaataaaacattttatccagtaa

SEQ ID NO: 31474 - DNA, 543 bp, Homo sapiens
atagtgctcgcagccccgctgacctcgctcttgaccgctggcgccatcttcccgggccgtcgccgccatctcctccacctcccctcacattccaccgatccttcccccaggataaaaaccacgcccagagaagctgcgcctctctagcacacccctcccagccccagcggccactagcgacaatatggctcctaagcacgtgacccggggcagacggatttccggttcccggggctacgaggcggaagcgaaggcagacgcagtctccgtcgttgacgttagtcgcagtcttcgctgctaacgtcaccagctaaaccgtgaggacaaaaagtaaggaaaaatagacacactccaccatgacctcatggaactaacaagactggtggaggaggaagacattaataagagcaatcactgcaataaatttttgttatgagttgctaaaatggtgaaatgctgctccgccattggatgtgcttctcgctgcttgccaaattcgaagttaaaaggactgacatttcacgtattccccacagatgaaaa

SEQ ID NO: 31475 - DNA, 313 bp, Homo sapiens
cagagaccactgtgcaagcctaatcacttcccaagaagggttttgctttaaagttttgttatgagttgctaaaatggtgaaatgctgctccgccattggatgtgcttctcgctgcttgccaaattcgaagttaaaaggactgacatttcacgtattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactg

SEQ ID NO: 31476 - DNA, 1161 bp, Homo sapiens
ggtaataactcttaggttgcctgttttcccccaatcgctacccgcccaaatctcagggcgtagttcggcgcgaggttggcggcagcggcgcggagacgctggttggccccagaggaaaggacgctcactgggcgcatcgttacctgtgacgggtcctccctctctccctccggtggcggggagcctggagaaaggggcggagctcggcccgggccctgggctcagcgggtcccgcgcgctgctcttggacgccagggtgctcgctggcacctcgaagtgcttcttgcttcctccctttcccgtttacttgctgttctttcaaaatatgtactgacattcactattgccagtcaccagctaaaccgtgaggacaaaaagtaaggaaaaatagacacactccaccatgacctcatggaactaacaagactggtggaggaggaagacattaataagagcaatcactgcaataaatttttgttatgagttgctaaaatggtgaaatgctgctccgccattggatgtgcttctcgctgcttgccaaattcgaagttaaaaggactgacatttcacgtattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactgaaacctggagtcataccttctatctttgattctccatatcacctacaggggaaaagagaaaaacttcattgtagaaaaaacttcaccctcaaaaccgttccagccactaactacaatcaccatcttgttggtgcttcctcatgtattgaagaattccaatcccagttcatttttgaacatagctacagtgtaatggacagtccaaagaaacttaagcataaattagatcatgtgatcggcgagctagaggatacaaaggaaagtctacggaatgttttagaccgagaaaaacgttttcagaaatcattgaggaagacaatcagggaattaaaggatgaatgtctgatcagccaagaaacagcaaatagactggacactttctgttgggactgttgtcaggagagcatagaacaggactatatttcatga

SEQ ID NO: 31477 - DNA, 1825 bp, Homo sapiens
cacagccagtgtactggatgcctgattaagcgtcatggggtctttcatccagactgcgttttcattattcgctgaaacatacaggttttaatttttacgaggctaaggccacggccgcctcacctcggtttttgccgccacctagaggaactatgtgcgccccaacggttgcccggatgtaggcgtagggtggagccgtaagagattgactagccagttgatttggttggcgcaggctcagaaacgccgtgacgccgcccttccccccaacacgtgatgaaagtcggggtgacgaagggccggctttgcgcaggtgcacagtactcgctatggcccattcgtcacgtgacgagggcgggactgtggcactgtggaggggcgcctagtaggcaggcgctctcagctctctccccggtacgtgacgagactccacggacgtcacgtgaggcaggcggcgagcgcgggtggggcggggttaggcggcgctccgcgagaaccaaagtgcagccgctgacccggcaaaactcagcgggggctggatagccatgcccaagtactgcagggcgccgaactgctccaacactgcgggccgcctgggtgcagacaaccgccctgtgagcttctacaagttcccactgaaggatggtccccggctgcaggcctggctgcagcacatgggctgtgagcactgggtgcccagctgccaccagcacttgtgcagcgagcacttcacaccctcctgcttccagtggcgctggggtgtgcgctacctgcggcctgatgcagtgccctccatcttctcccggggaccacctgccaagagtcagcggaggacccgaagcacccagaagccagtctcgccgccgcctcccctacagaagaatacacccctgccccagagccctgccatcccagtctctggcccagtgcgcctagtggtgctgggccccacatcggggagccccaagactgtggccaccatgctcctgacccccctggcccctgcgccaactcctgagcggtcacaacctgaagtccctgcccaacaggcccagaccgggctgggcccagtgctgggagcactgcaacgccgggtgcggaggctgcaacggtgccaggagcggcaccaggcgcagctgcaggccctggaacggctggcacagcagctacacggggagagcctgctggcacgggcacgccggggtctgcagcgcctgacaacagcccagacccttggacctgaggaatcccaaaccttcaccatcatctgtggagggcctgacatagccatggtccttgcccaggaccctgcacctgccacagtggatgccaagccggagctcctggacactcggatccccagtgcataaggatcaagacagacaatgtcgagggacaaaagatagaagatggaggaggaaagacattatacgtgggcttggcccagccccaccgcccacgcctgggtagtagcagtgcctccctcaagggcctgggttctaccaccccactcctagggatctcttgaaccttaggggtgacctgggcccaagtctctcatcagcccccaatcccctgggtaccaggcttctgccacccccggctcagatctttgcaaatcagtacgacagcctcagagcagagcaagggttgtttgggagaatcatacctggttctaaggagtcccacgctttttgccaagcctggtactgagttcatgataccatggtggacacagctgagaaaatccctgccctcatggtgctcattctacttgagtagacgatgaactagtaaacaaataaacaagaacactgcagacatg

SEQ ID NO: 31478 - DNA, 1674 bp, Homo sapiens
atgcctgattaagcgtcatggggtctttcatccagactgcgttttcattattcgctgaaacatacaggttttaatttttacgaggctaaggccacggccgcctcacctcggtttttgccgccacctagaggaactatgtgcgccccaacggttggccggctttgcgcaggtgcacagtactcgctatggcccattcgtcacgtgacgagggcgggactgtggcactgtggaggggcgcctagtaggcaggcgctctcagctctctccccggtacgtgacgagactccacggacgtcacgtgaggcaggcggcgagcgcgggtggggcggggttaggcggcgctccgcgagaaccaaagtgcagccgctgacccggcaaaactcagcgggggctggatagccatgcccaagtactgcagggcgccgaactgctccaacactgcgggccgcctgggtgcagacaaccgccctgtgagcttctacaagttcccactgaaggatggtccccggctgcaggcctggctgcagcacatgggctgtgagcactgggtgcccagctgccaccagcacttgtgcagcgagcacttcacaccctcctgcttccagtggcgctggggtgtgcgctacctgcggcctgatgcagtgccctccatcttctcccggggaccacctgccaagagtcagcggaggacccgaagcacccagaagccagtctcgccgccgcctcccctacagaagaatacacccctgccccagagccctgccatcccagtctctggcccagtgcgcctagtggtgctgggccccacatcggggagccccaagactgtggccaccatgctcctgacccccctggcccctgcgccaactcctgagcggtcacaacctgaagtccctgcccaacaggcccagaccgggctgggcccagtgctgggagcactgcaacgccgggtgcggaggctgcaacggtgccaggagcggcaccaggcgcagctgcaggccctggaacggctggcacagcagctacacggggagagcctgctggcacgggcacgccggggtctgcagcgcctgacaacagcccagacccttggacctgaggaatcccaaaccttcaccatcatctgtggagggcctgacatagccatggtccttgcccaggaccctgcacctgccacagtggatgccaagccggagctcctggacactcggatccccagtgcataaggatcaagacagacaatgtcgagggacaaaagatagaagatggaggaggaaagacattatacgtgggcttggcccagccccaccgcccacgcctgggtagtagcagtgcctccctcaagggcctgggttctaccaccccactcctagggatctcttgaaccttaggggtgacctgggcccaagtctctcatcagcccccaatcccctgggtaccaggcttctgccacccccggctcagatctttgcaaatcagtacgacagcctcagagcagagcaagggttgtttgggagaatcatacctggttctaaggagtcccacgctttttgccaagcctggtactgagttcatgataccatggtggacacagctgagaaaatccctgccctcatggtgctcattctacttgagtagacgatgaactagtaaacaaataaacaagaacactgc

SEQ ID NO: 31479 - DNA, 971 bp, Homo sapiens
aaagtgcagccgctgacccggcaaaactcagcgggggctggatagccatgcccaagtactgcagggcgccgaactgctccaacactgcgggccgcctgggtgcagacaaccgccctgtgagcttctacaaagtcagcggaggacccgaagcacccagaagccagtctcgccgccgcctcccctacagaagaatacacccctgccccagagccctgccatcccagtctctggcccagtgcgcctagtggtgctgggccccacatcggggagccccaagactgtggccaccatgctcctgacccccctggcccctgcgccaactcctgagcggtcacaacctgaagtccctgcccaacaggcccagaccgggctgggcccagtgctgggagcactgcaacgccgggtgcggaggctgcaacggtgccaggagcggcaccaggcgcagctgcaggccctggaacggctggcacagcagctacacggggagagcctgctggcacgggcacgccggggtctgcagcgcctgacaacagcccagacccttggacctgaggaatcccaaaccttcaccatcatctgtggagggcctgacatagccatggtccttgcccaggaccctgcacctgccacagtggatgccaagccggagctcctggacactcggatccccagtgcataaggatcaagacagacaatgtcgagggacaaaagatagaagatggaggaggaaagacattatacgtgggcttggcccagccccaccgcccacgcctgggtagtagcagtgcctccctcaagggcctgggttctaccaccccactcctagggatctcttgaaccttaggggtgacctgggcccaagtctctcatcagcccccaatcccctgggtaccaggcttctgccacccccggctcagatctttgcaaatcagtacgacagcctcagagcagagcaagggttgtttgggaga

SEQ ID NO: 31480 - DNA, 3808 bp, Homo sapiens
gattcatgctgtcgcgggaaccccgaaggtggggccccacgtaacaagaagatgacccgaagttgctccgcagtgggctgcagcacccgtgacaccgtgctcagccgggagcgcggcctctccttccaccaatttccaactgataccatacagcgctcaaaatggatcagggctgttaatcgtgtggaccccagaagcaaaaagatttggattccaggaccaggtgctatactgtgttccaaacattttcaagaaagtgactttgagtcatatggcataagaagaaagctgaaaaaaggagctgtgccttctgtttctctatacaagattcctcaaggtgtacatcttaaaggtaaagcaagacaaaaaatcctaaaacaacctcttccagacaattctcaagaagttgctactgaggaccataactatagtttaaagacacctttgacgataggtgcagagaaactggctgaggtgcaacaaatgttacaagtgtccaaaaaaagacttatctccgtaaagaactacaggatgatcaagaagagaaagggtttacgattaattgatgcacttgtagaagagaaactactttctgaagaaacagagtgtctgctacgagctcaattttcagattttaagtgggagttatataattggagagaaacagatgagtactccgcagaaatgaaacaatttgcatgtacactctacttgtgcagtagcaaagtctatgattatgtaagaaagattcttaagctgcctcattcttccatcctcagaacgtggttatccaaatgccaacccagtccaggtttcaacagcaacattttttcttttcttcaacgaagagtagagaatggagatcagctctatcaatactgttcattgttaataaaaagtatgcctctcaagcaacagcttcagtgggatcctagcagtcacagtttgcaggggtttatggactttggtcttggaaaacttgatgctgatgaaacgccacttgcttcagaaactgttttgttaatggcagtgggtatttttggccattggagaacacctcttggttatttttttgtaaacagagcatctggatatttgcaggctcagctgcttcgtctgactattggtaaactgagtgacataggaatcacagttctggctgttacatctgatgccacagcacatagtgttcagatggcaaaagcattggggatacatattgatggagacgacatgaaatgtacatttcagcatccttcatcttctagtcaacagattgcatacttctttgactcttgccacttgctaagattaataagaaatgcatttcagaattttcaaagcattcagtttattaatggtatagcacattggcagcacctcgtggagttagtagcactggaggaacaggaattatcaaatatggaaagaataccaagtacacttgcaaatttgaaaaatcatgtactgaaagtgaatagtgccacccaactctttagtgagagtgtagccagtgcattagaatatttgttatccttagacctgccaccttttcaaaactgtattggtaccatccattttttacgtttaattaacaatctgtttgacatctttaatagtaggaactgttatggaaagggacttaaagggcctctgttgcctgaaacttacagtaaaataaaccacgtgttaattgaagccaagactatttttgttacattatctgacactagcaataatcaaataattaaaggtaagcaaaaactaggattcctgggatttttgctcaatgctgagagcttaaaatggctctaccaaaattatgttttcccaaaggtcatgccttttccttatcttctgacttacaaattcagtcatgatcatctggaattatttctaaagatgcttaggcaggtattagtaacaagttctagccctacctgcatggcattccagaaagcttactataatttggagaccagatacaaatttcaagatgaagtttttctaagcaaagtaagcatctttgacatttcaattgctcgaaggaaagacttggcgctttggacagttcaacgtcagtatggtgtcagcgttacaaagactgtctttcacgaagagggtatttgtcaagactggtctcattgttcactaagtgaggcattactagacctgtcagatcataggcgaaatctcatctgttatgctggttatgttgcaaacaagttatcagctcttttaacttgtgaggactgcatcactgcactgtatgcatcggatctcaaagcctctaaaattgggtcactattatttgttaaaaagaagaatggtttgcattttccttcagaaagtctgtgtcgggtcataaatatttgtgagcgagttgtaagaacccattcaagaatggcaatttttgaactagtttctaaacaaagggaattgtatcttcaacagaaaatattatgtgagctttctgggcatattaatctttttgtagatgtgaataagcatctctttgatggagaagtgtgtgccatcaatcactttgtcaagttgctaaaggatataataatctgtttcttaaatatcagagctaaaaatgttgcacagaatcctttaaaacatcattcagagagaactgatatgaaaactttatcaaggaaacactggtcatctgtacaggattataaatgttcaagttttgctaataccagtagtaaattcaggcatttgctaagtaacgatggatatccattcaaatgagagacctaaaatatattaacattttaattaagaatacttgatcaacattttttgaagttcaatttaccatattttataaattgcgcattctgcacagtggacaagtttgcaattctgacttattaaaatttcaaattctgcatatcacaaaatctccttatacttttggtatggcttgcagcatttatgagttttccaaaatatagaaagcagtaggtcagtaggagcaaactagccaacaggtactgtctttgaatttactactgtaagactaagcagtgttactggacacagttttaacttgttcaatctgcttcaaaaacaagaaaaacaacaactatgagttatcaaaatattgactccatttatgactagactacatttctgaaagatctttggtttatgattcttaagaatattgacaatacctataaaactttgaagataacttttacttaaatatgaaaattatagtttgaaaattaggctcaagcaaatatcaaatactgcaaaaatccccttgtcccaggataccctaaaatagaagtgcttaaactttgtcaggcagaaggtaaagtacatgagccatgagattcttccttgtgctgcagccacgctggggagtgcaatctggaaagaacatacctaatgtgtttttcaccatccattatctctgaactttgaaatattacttttgaataataggctggacacttagtttgacttgaaagagctcaatgctcatcggaaaacagggagaaacctaatctgaagatggaagcatactaaggacaattttctccactcacatccacatttgaaaagagggacagaaaaacataggtaactctactttcacaaatgaggatagtttaacggatagaagaaacaagcacattattcacctgtgttgtaaaacatctactcttttttgtcactgaataagtgttcccaaagtacagttaatcctaatatgaaaacttagaattgtaaaagattaatgataacgtaaaagtatattgattaaaattccccttacaaagta

SEQ ID NO: 31481 - DNA, 3627 bp, Homo sapiens
attcatgctgtcgcgggaaccccgaaggtggggccccacgtaacaagaagatgacccgaagttgctccgcagtgggctgcagcacccgtgacaccgtgctcagccgggagcgcggcctctccttccaccaatttccaactgataccatacagcgctcaaaatggatcagggctgttaatcgtgtggaccccagaagcaaaaagatttggattccaggaccaggtgctatactgtgttccaaacattttcaagaaagtgactttgagtcatatggcataagaagaaagctgaaaaaaggagctgtgccttctgtttctctatacaagattcctcaaggtgtacatcttaaaggtaaagcaagacaaaaaatcctaaaacaacctcttccagacaattctcaagaagttgctactgaggaccataactatagtttaaagacacctttgacgataggtgcagagaaactggctgaggtgcaacaaatgttacaagtgtccaaaaaaagacttatctccgtaaagaactacaggatgatcaagaagagaaagggtttacgattaattgatgcacttgtagaagagaaactactttctgaagaaacagagtgtctgctacgagctcaattttcagattttaagtgggagttatataattggagagaaacagatgagtactccgcagaaatgaaacaatttgcatgtacactctacttgtgcagtagcaaagtctatgattatgtaagaaagattcttaagctgcctcattcttccatcctcagaacgtggttatccaaatgccaacccagtccaggtttcaacagcaacattttttcttttcttcaacgaagagtagagaatggagatcagctctatcaatactgttcattgttaataaaaagtatgcctctcaagcaacagcttcagtgggatcctagcagtcacagtttgcaggggtttatggactttggtcttggaaaacttgatgctgatgaaacgccacttgcttcagaaactgttttgttaatggcagtgggtatttttggccattggagaacacctcttggttatttttttgtaaacagagcatctggatatttgcaggctcagctgcttcgtctgactattggtaaactgagtgacataggaatcacagttctggctgttacatctgatgccacagcacatagtgttcagatggcaaaagcattggggatacatattgatggagacgacatgaaatgtacatttcagcatccttcatcttctagtcaacagattgcatacttctttgactcttgccacttgctaagattaataagaaatgcatttcagaattttcaaagcattcagtttattaatggtatagcacattggcagcacctcgtggagttagtagcactggaggaacaggaattatcaaatatggaaagaataccaagtacacttgcaaatttgaaaaatcatgtactgaaagtgaatagtgccacccaactctttagtgagagtgtagccagtgcattagaatatttgttatccttagacctgccaccttttcaaaactgtattggtaccatccattttttacgtttaattaacaatctgtttgacatctttaatagtaggaactgttatggaaagggacttaaagggcctctgttgcctgaaacttacagtaaaataaaccacgtgttaattgaagccaagactatttttgttacattatctgacactagcaataatcaaataattaaaggtaagcaaaaactaggattcctgggatttttgctcaatgctgagagcttaaaatggctctaccaaaattatgttttcccaaaggtcatgccttttccttatcttctgacttacaaattcagtcatgatcatctggaattatttctaaagatgcttaggcaggtattagtaacaagttctagccctacctgcatggcattccagaaagcttactataatttggagaccagatacaaatttcaagatgaagtttttctaagcaaagtaagcatctttgacatttcaattgctcgaaggaaagacttggcgctttggacagttcaacgtcagtatggtgtcagcgttacaaagactgtctttcacgaagagggtatttgtcaagactggtctcattgttcactaagtgaggcattactagacctgtcagatcataggcgaaatctcatctgttatgctggttatgttgcaaacaagttatcagctcttttaacttgtgaggactgcatcactgcactgtatgcatcggatctcaaagcctctaaaattgggtcactattatttgttaaaaagaagaatggtttgcattttccttcagaaagtctgtgtcgggtcataaatatttgtgagcgagttgtaagaacccattcaagaatggcaatttttgaactagtttctaaacaaagggaattgtatcttcaacagaaaatattatgtgagctttctgggcatattaatctttttgtagatgtgaataagcatctctttgatggagaagtgtgtgccatcaatcactttgtcaagttgctaaaggatataataatctgtttcttaaatatcagagctaaaaatgttgcacagaatcctttaaaacatcattcagagagaactgatatgaaaactttatcaaggaaacactggtcatctgtacaggattataaatgttcaagttttgctaataccagtagtaaattcaggcatttgctaagtaacgatggatatccattcaaatgagagacctaaaatatattaacattttaattaagaatacttgatcaacattttttgaagttcaatttaccatattttataaattgcgcattctgcacagtggacaagtttgcaattctgacttattaaaatttcaaattctgcatatcacaaaatctccttatacttttggtatggcttgcagcatttatgagttttccaaaatatagaaagcagtaggtcagtaggagcaaactagccaacaggtactgtctttgaatttactactgtaagactaagcagtgttactggacacagttttaacttgttcaatctgcttcaaaaacaagaaaaacaacaactatgagttatcaaaatattgactccatttatgactagactacatttctgaaagatctttggtttatgattcttaagaatattgacaatacctataaaactttgaagataacttttacttaaatatgaaaattatagtttgaaaattaggctcaagcaaatatcaaatactgcaaaaatccccttgtcccaggataccctaaaatagaagtatattttgatgtttgtttattctacctcaaacagaggcttaagttttgaagtgtaaccagtttatacttcattttatacaaaacttattgctgagaagtctgaatattgtgctttttgttgtttgtaaatagaattgaatttaaatacaccaggataaatcttatttaaaggaagcctgtttgaaaatcaccaactttaacttattgcttatataaatccaagctctgtacctgatctttatgtaaagcaagattcatatgtgtagtatctaatgccctttggtgttacatttgactaaaatacaaatgtctgtatt

SEQ ID NO: 31482 - DNA, 2161 bp, Homo sapiens
gaagctgcctccgccatcttggagatgggagacgggcgatggctgtggtccttctgctaatgcaaacaacaaaacgggcacactagtcacccccgagggaggccaccatcactgtaactgttggccaaagctacaaaagaagcgagggaatccaaccgagcgcagcgacactgagaacagcttcccctgccttctgcggcggcagaagtgaagtgcctgaggaccggaaggatggtgcagtcctgctccgcctacggctgcaagaaccgctacgacaaggacaagcccgtttctttccacaagtttcctcttactcgacccagtctttgtaaagaatgggaggcagctgtcagaagaaaaaactttaaacccaccaagtatagcagtatttgttcagagcactttactccagactgctttaagagagagtgcaacaacaagttactgaaagagaatgctgtgcccacaatatttctttgtactgagccacatgacaagaaagaagatcttctggagccacaggaacagcttcccccacctcctttaccgcctcctgtttcccaggttgatgctgctattggattactaatgccgcctcttcagacccctgttaatctctcagttttctgtgaccacaactatactgtggaggatacaatgcaccagcggaaaaggattcatcagctagaacagcaagttgaaaaactcagaaagaagctcaagaccgcacagcagcgatgcagaaggcaagaacggcagcttgaaaaattaaaggaggttgttcacttccagaaagagaaagacgacgtatcagaaagaggttatgtgattctaccaaatgactactttgaaatagttgaagtaccagcataaaaaaatgaaatgtgtattgatttctaatggggcaataccacatatcctcctctagcctgtaaaggagtttcatttaaaaaaataacatttgattacttatataaaaacagttcagaatatttttttaaaaaaaattctatatatactgtaaaattataaatttttttgtttgtaatttcaggttttttacattttaacaaaatattttaaaagttataaactaacctcagacctctaatgtaagttggtttcaagattggggattttggggtttttttttagtatttatagaaataatgtaaaaataaaaagtaaagagaatgagaacagtgtggtaaaagggtgatttcagtttaaaacttaaaattagtactgttttattgagagaatttagttatattttaaatcagaagtatgggtcagatcatgggacataacttcttagaatatatatatacatatgtacatattctcatatgtaaagtcacaaggttcatttatctttctgaatcagttatcaaagataaattggcaagtcagtacttaagaaaaaagatttgattatcatcacagcagaaaaaagtcattgcatatctgatcaataacttcagattctaagagtggattttttttttttacatgggctcctattttttcccctactgtcttgcattataaaattagaagtgtattttcagtggaagaaacatttttcaataaataaagtaaggcattgtcatcaatgaagtaattaaaactgggacctgatctatgatacgcttttttctttcattacaccctagctgaaggacatccagttccccagctgtagttatgtatctgccttcaagtctctgacaaatgtgctgtgttagtagagtttgatttgtatcatatgataatcttgcacttgactgagttgggacaaggcttcacataaaaaattatttcttcacttttaacacaagttagaaattatatcccatttagttaagtgcgtgatttatattcagaacaacctactatgtagcgtttattttactgaatgtggagatttaaacactgaggtttctgttcaaactgtgagttctgttctttgtgagaaattttacatatattggaagtgaaaatatgttctgagtaaacaaatattgctatgggagttatctttttagatttagaataactgttccaatgataattattacttttatatttcaaagtacactaagatcgttgaagagcaatagaacctttaagacagtattaaaggtgtgaaacaatggca

SEQ ID NO: 31483 - DNA, 1943 bp, Homo sapiens
ggagatgggagacgggcgatggctgtggtccttctgctaatgcaaacaacaaaacgggcacactagtcacccccgagggaggccaccatcactgtaactgttggccaaagctacaaaagaagcgagggaatccaaccgagcgcagcgacactgagaacagcttcccctgccttctgcggcggcagaagtgaagtgcctgaggaccggaaggatggtgcagtcctgctccgcctacggctgcaagaaccgctacgacaaggacaagcccgtttctttccacaaaaagaagatcttctggagccacaggaacagcttcccccacctcctttaccgcctcctgtttcccaggttgatgctgctattggattactaatgccgcctcttcagacccctgttaatctctcagttttctgtgaccacaactatactgtggaggatacaatgcaccagcggaaaaggattcatcagctagaacagcaagttgaaaaactcagaaagaagctcaagaccgcacagcagcgatgcagaaggcaagaacggcagcttgaaaaattaaaggaggttgttcacttccagaaagagaaagacgacgtatcagaaagaggttatgtgattctaccaaatgactactttgaaatagttgaagtaccagcataaaaaaatgaaatgtgtattgatttctaatggggcaataccacatatcctcctctagcctgtaaaggagtttcatttaaaaaaataacatttgattacttatataaaaacagttcagaatatttttttaaaaaaaattctatatatactgtaaaattataaatttttttgtttgtaatttcaggttttttacattttaacaaaatattttaaaagttataaactaacctcagacctctaatgtaagttggtttcaagattggggattttggggtttttttttagtatttatagaaataatgtaaaaataaaaagtaaagagaatgagaacagtgtggtaaaagggtgatttcagtttaaaacttaaaattagtactgttttattgagagaatttagttatattttaaatcagaagtatgggtcagatcatgggacataacttcttagaatatatatatacatatgtacatattctcatatgtaaagtcacaaggttcatttatctttctgaatcagttatcaaagataaattggcaagtcagtacttaagaaaaaagatttgattatcatcacagcagaaaaaagtcattgcatatctgatcaataacttcagattctaagagtggattttttttttttacatgggctcctattttttcccctactgtcttgcattataaaattagaagtgtattttcagtggaagaaacatttttcaataaataaagtaaggcattgtcatcaatgaagtaattaaaactgggacctgatctatgatacgcttttttctttcattacaccctagctgaaggacatccagttccccagctgtagttatgtatctgccttcaagtctctgacaaatgtgctgtgttagtagagtttgatttgtatcatatgataatcttgcacttgactgagttgggacaaggcttcacataaaaaattatttcttcacttttaacacaagttagaaattatatcccatttagttaagtgcgtgatttatattcagaacaacctactatgtagcgtttattttactgaatgtggagatttaaacactgaggtttctgttcaaactgtgagttctgttctttgtgagaaattttacatatattggaagtgaaaatatgttctgagtaaacaaatattgctatgggagttatctttttagatttagaataactgttccaatgataattattacttttatatttcaaagtacactaagatcgttgaagagcaatagaacctttaagacagtattaaaggtgtgaaacaatgg

SEQ ID NO: 31484 - DNA, 5719 bp, Homo sapiens
atacagctcttccgaggtggagagggctctcgccagctctgactgctgctgaacccggatcctgctcctcctcccagaggaggtctgcaccccggcttgcctcctcgctcacccactcctcgcccccgactccagcgactcccaccccggtaaggcctgcctcgaaagcggaaacggtccaaggcgaggtggctccgctcccagaaagacggccggggactgctttcggacagtgagctcgaaggcatccgtacagaaggcggatgagaccggaacggttctttgggtcggtagctgctgggtcccctgaggtggccccgctcagacgcgtgccgcgagcgtgagaaattcctcagctgctgctgagaagaggacgatgacgaggaagagccaccgcctccgccagatccaccgccccgggccgagtgaggaggccttcgccgcggatagggtaacagcccgccgccgctgctgctgctgctgctccgactccgtatctggctgttattatcgtcgtcactgatttccccatcttcaagctccccttcttccttcggcgagaggccactggaggccggggccggagtatctgcggtcgccatccggggagcagcgccttccacacaaccttagccctccgtccggggatccgcccgacaattgcctcgtttcccttctttcctaacggactgggtcggtgcggtcttaccctactcggacaccaagcggcctctgctccccaacttccccgcaccccagcaccccagctctctctcgccggaccgtcgcaacccagttccctttcctagcgcccccttgctcctcagcgatcggggttcttccgcctcgcgagaaagggactctggtagcggctgtacccgaaacgtcacttcctgcgacacgcaggaaacaaaggctcccagttcacgcgataataagaccaactcgatactcactaggatttgtagtctttcgtctttcttcgggtttactcttccggtcctagggtcacacccaccgcagggtctggcttggtacagttgggtgcatgcagaagtaggtggagctgctgttgcagccttgagagagttttattgtaaaactcttgtaatttatagtaatcggaggggaaaacacctcttccttttaattgctctgaggaccgctgccaaagaaacgcagtagatccgctccctcttgggggcggggagaaagaacgggttgtgtccgccatgttggtgaagtcaagcgaaggcgactagagctccaggagggccagttctgtgggctctagtcggccatattaataaagagaaagggaaggctgaccgtccttcgcctccgcccccacatacacaccccttcttcccactccgctctcacgactaagctctcacgattaaggcacgcctgcctcgattgtccagcctctgccagaagaaagcttagcagccagcgcctcagtagagacctaagggcgctgaatgagtgggaaagggaaatgccgaccaattgcgctgcggcgggctgtgccactacctacaacaagcacattaacatcagcttccacaggtttcctttggatcctaaaagaagaaaagaatgggttcgcctggttaggcgcaaaaattttgtgccaggaaaacacacttttctttgttcaaagcactttgaagcctcctgttttgacctaacaggacaaactcgacgacttaaaatggatgctgttccaaccatttttgatttttgtacccatataaagtctatgaaactcaagtcaaggaatcttttgaagaaaaacaacagttgttctccagctggaccatctaatttaaaatcaaacattagtagtcagcaagtactacttgaacacagctatgcctttaggaatcctatggaggcaaaaaagaggatcattaaactggaaaaagaaatagcaagcttaagaagaaaaatgaaaacttgcctacaaaaggaacgcagagcaactcgaagatggatcaaagccacgtgtttggtaaagaatttagaagcaaatagtgtattacctaaaggtacatcagaacacatgttaccaactgccttaagcagtcttcctttggaagattttaagatccttgaacaagatcaacaagataaaacactgctaagtctaaatctaaaacagaccaagagtaccttcatttaaatttagcttgcacagagcttgatgcctatccttcattcttttcagaagtaaagataattatggcacttatgccaaaattcattatttaataaagttttacttgaagtaacattactgaatttgtgaagacttgattacaaaagaataaaaaacttcatatggaaattttatttgaaaatgagtggaagtgccttacattagaattacggacttaaaaattttgctaataaattgtgtgtttgaaaggtgttttttgtttttgtctttttaaactactgttaaaagaacagcttatgataagtaatatgtttaacttagagaagaattttttcctgtaccaaagttggcatattgcattctaaataagatgctaaataagagttaaccaacattcaacatgaccttaaaactgctgggttttgtattaattaaattataattggcactgtgatttgaaaaatttatagaaaaaaaggtacagggcaagtttttaaattaaaactttctatattttgttttaccagtaaaagtgagcttatcatggcctctctcataagaatgattttaaaataggttgtaaaatattttgaaaatatttgaatgtgaagtaccattgagtcatccaaactaggtaaggcctcaagtactttaaactagtaaaatctagtagctgataatattcacctaagtaagtgttgtaaaataattcagagttcaggacctagcttagataaatgtatactactctttttctcataataaaaatcttacatttccaacttcaaaattggtgcttccatatttgttgataaccaaaactcctaaggttttttgttttctttttaactactttccaaatgcatactatacctcagaaatagtgtatcaatatagtgggctttttttttcctcttcataaacccacagtaaaatttaatcacaggaaactacttatatcttcacactttgtattgataacttaaaatggcatcagtttatcttagacatcagcttgctttttatctccttttttagtgagtgaaatagagcaactagcatgcctgtgttcccagctacttgggaggctaaggtgggaagatcaattgaacctaggaggttgaggctatagtgagctgtgattgcacgactgcactccagcctgggcaatggagtgagactcctgtctctaaaacagcaacaacaaaaataaagcaaccatagtgcataagggaaattaaatgttccctatagaaatatgtgtatgtctgtgatagtggtatgcaaatgctaattattttataaaataaaagttcagaactattcttatcattgccacttgaacaattaaagggtttgctttatttcactaatgtttaataggaaccctttgcttcaaacagctttgttgaaatcatgtaaaaatttgttaatagagaatcaagttatttaactcaacttatttaattcaagcttgtgatactaacatacaaaggtagcataaaccaagtcataaattgctgtaatctttcctgtaaagtaatagctacttcatgatttttttaaaaatttcatttttttgctatttaggattgcatttgcttggctcctagtaacaattcttttacagtattagcactctctttactaaggaatgcctcccaaggaaatgcaaaggtaggaaaagtctcttagaatgcccatgaggtatttaaaacagatatttatgaaaatctttttgtgaatgttataaatcttgctagttattttatctttatcttaagtattagatgtagttccttggaattgtcattacatatttatttttttctagtatggtttcaaataactttttgccaacatataatcatcatcaaacattcactgaccatatctattttataactcaaaataagttggacaaataatcattttaataaaaactattttttccaagtataaccactgtcatgtggttcacccttcaccccagatacaaaacacttatttgtgtagcccagttcccatctacagtaataccttgaaaccttaataaattttaaaaatcataaaaataaaatattgtaaaatacaacaaattttggacaaggttacttcatcttcattcattattacctgacagtattaaactactactcaataattttagagtaaacttttctgtgttttctccgtgattttcattgtgctgtcctgacaacatgctccaaactctttgcatcaaattgttttattaacatacatttgtctaccttaaaactagctttattcacagagaaaaacctaaaaggagtctattaaaatgctgctttcagtttgatagttttttttttaatcactctgaccataaactaactgaaattataatggattttttttcctctcccggtcacaacacagatcttctgttcatttgttctctgtctactgggcaccaacctctacaaagaaccagccaaaggctaggtacttgatataaaaaggaatattacattattttctgccctcaagttgctctatctcctgaaagaaacaagtaatatttataatacaatatgataaatgctacaaaagaaatagctgtaaagtcctttggtaaatgctgttgaattggaattcagtaagaactataaactgtagacctttttataatcaaatgcttttgtcttgaaacaaaacagattcctccttatattgacttagcaaaggaggtacaaggacattggcatttgacctgaattatggtgttttattgaatgagctataagacaacatttttaccctttaaaatgaacactgaacaaatgtgttaatggtatctttgttaaaaggaaaacatagctataaataaaatactacatcgaaatccagcactggagttcatttgaaatttgatattttgtgtaaaataacaaacctattaacacagatttttaaaataactcagaatcgtataaagcactttggtacttatttgttctcttttcccttacattctgtgtggtaggtggtattatctctgatttacacatgaagacatccttgttaatgcaatttatttattcattcgggcatttactgtgtgccaacttgcaaaaggaatagaaatgtctgtgatctagatagttctagattgaacatagattttctgccaacaaatcctctctgctgttcacattatcctttgtttaacgtatgaaccaggttactaaaataggataaatcatgtgtcttaaaatatgaaaatagtaaagtctttgaggtcacttgatcttctctaagtagactttataatattgtgttttatctcatttctcaatattagaatacgggtagattttaattttgctataatataggaaatggttcatctttgtaccaaaatattgcattcttctgatatttagacagttggaaactttctaaaattgaggattttgtagtgtatactaaataattgcatattcaaaaaaatgtattctgagtatggtgatattaaacatttttccccaa

SEQ ID NO: 31485 - DNA, 1366 bp, Homo sapiens
ttccagttgtccaagcctgtgagtggctatgcgtcctggttgggtgctcaaagcaaggaggtgaaaggcgaccagcattggcgaatggggtccctcccctctccgcaggccccgccgccgccgccatctttgttgggggcagccaggcctggctcgagatgccgaagtcgtgcgcggcccggcagtgctgcaaccgctacagcagccgcaggaagcagctcaccttccaccggtttccgttcagccgcccggagctgctgaaggaatgggtgctgaacatcggccggggcaacttcaagcccaagcagcacacggtcatctgctccgagcacttccggccagagtgcttcagcgcctttggaaaccgcaagaacctaaagcacaatgccgtgcccacggtgttcgcctttcaggaccccacacagcaggtgagggagaacacagaccctgccagtgagagaggaaatgccagctcttctcagaaagaaaaggtcctccctgaggcgggggccggagaggacagtcctgggagaaacatggacactgcacttgaagagcttcagttgcccccaaatgccgaaggccacgtaaaacaggtctcgccacggaggccgcaagcaacagaggctgttggccggccgactggccctgcaggcctgagaaggacccccaacaagcagccatctgatcacagctatgcccttttggacttagattccctgaagaaaaaactcttcctcactctgaaggaaaatgaaaagctccggaagcgcttgcaggcccagaggctggtgatgcgaaggatgtccagccgcctccgtgcttgcaaagggcaccagggactccaggccagacttgggccagagcagcagagctgagccccacaggctccggacgcagaggtggcagtggcaccagggccggcagagctttggagctctggctgtggacatttttgtctgctgtggacactgagaaagttggccatgaggcctgcttggccggggatcgagacagtagccaagctccccggcgagagccccaatgccgtctgggggacgtttagaggcgtggcactaggagtgcacatctgtgagcatgacaagcttatcctcccatggtaacagaagtccaggctgaggctgattctggacgctgtcctttcagcacacgcagagcaaagatcgttggaagccccagtgtgggagatgctcctcagggaggaagccatgtgagggggctggctctgtggcgggtgagtggtcccctcctccatcagcctggacagccgctcggggttctaaggagtgactcctgtcccggcctggtgtgagtgggcagtgtaataaagtgtctttctatacgg

SEQ ID NO: 31486 - DNA, 1046 bp, Homo sapiens
ccgccatctttgttgggggcagccaggcctggctcgagatgccgaagtcgtgcgcggcccggcagtgctgcaaccgctacagcagccgcaggaagcagctcaccttccaccggtttccgttcagccgcccggagctgctgaaggaatgggtgctgaacatcggccggggcaacttcaagcccaagcagcacacggtcatctgctccgagcacttccggccagagtgcttcagcgcctttggaaaccgcaagaacctaaagcacaatgccgtgcccacggtgttcgcctttcaggaccccacacaggtgagggagaacacagaccctgccagtgagagaggaaatgccagctcttctcagaaagaaaaggtcctccctgaggcgggggccggagaggacagtcctgggagaaacatggacactgcacttgaagagcttcagttgcccccaaatgccgaaggccacgtaaaacaggtctcgccacggaggccgcaagcaacagaggctgttggccggccgactggccctgcaggcctgagaaggacccccaacaagcagccatctgatcacagctatgcccttttggacttagattccctgaagaaaaaactcttcctcactctgaaggaaaatgaaaagctccggaagcgcttgcaggcccagaggctggtgatgcgaaggatgtccagccgcctccgtgcttgcaaagggcaccagggactccaggccagacttgggccagagcagcagagctgagccccacaggctccggacgcagaggtggcagtggcaccagggccggcagagctttggagctctggctgtggacatttttgtctgctgtggacactgagaaagttggccatgaggcctgcttggccggggatcgagacagtagccaagctccccggcgagagccccaatgccgtctgggggacgtttagaggcgtggcactaggagtgcacatctgtgagcatgacaagcttatcctcccatggtaacagaagtccaggctgaggctgattctggacgctgtcctttcagca

SEQ ID NO: 31487 - DNA, 2053 bp, Homo sapiens
gttgggggcagccaggcctggctcgagatgccgaagtcgtgcgcggcccggcagtgctgcaaccgctacagcagccgcaggaagcagctcaccttccaccggtttccgttcagccgcccggagctgctgaaggaatgggtgctgaacatcggccggggcaacttcaagcccaagcagcacacggtcatctgctccgagcacttccggccagagtgcttcagcgcctttggaaaccgcaagaacctaaagcacaatgccgtgcccacggtgttcgcctttcaggaccccacacagcaggtgagggagaacacagaccctgccagtgagagaggaaatgccagctcttctcagaaagaaaagacttcaccctgccgttcccaggtcctccctgaggcgggggccggagaggacagtcctgggagaaacatggacactgcacttgaagagcttcagttgcccccaaatgccgaaggccacgtaaaacaggcaatgttgtttaatgtagaaaatggaaccccagcttcacgtgaagccttgtggttgagtgaggagtgaaggatggggaggaggcctctggggaaggggttccctccctcctgaagatgaacacacaatacacggaagagcgccagcctctgctttcaggaaaggtttattgtggtgagtgccttctgtacagtcgactgcaaatgaaacgcagaggatgggtgcccagaagcacctgcggcagaggcgcacgggaagcccggggcccaggctcatgcaacacgacgctcaccgcggctcgggccgtggggccgtcagagaaacctttttaaaaaatggagatgaatgttacagaattggacaacccgaactgcttttcaaaaccagaggaaggaggttcttagccgttactcagataccagtgctggggagggaggcctgacttcagcaacagctgtgggtgggctggaggccggcgcagcttggggccccccgcgccagctgtctcagccaccacctgtgcggcgcttgctccgaggggtcagcaagagcaactgatggctgccacttccaggccccgagagacaggcctcacgtaactttactgcagccgaggtccaggccgtggagggggtcctagctccgctgcattctgcatcccaagtgggcacgtggaggaagggtctgaaggaaggctccggagcacaggccctggtgttcctgtgaggacgctggacctgcaggagcggggagctgcagtgccacctgctgggtaccacgggccgggcctggggtccacgcctttgggttgggtgtgtctgatgtcttgccaagcgcctggtcctgtcctcttgagctgcccttgcccagcactgcactctggaggtgggtggtgcaggcggtggagggacacaggccagctcaagcccgctggtggcagggcgttttcccaccgggatacgggaagccacctgtgtcagggctaggccctgggatcgggagttacactaccctgtcccaagccgagggggccggtggaatgacttgagcagctctgggagtggggaaaaaagacgactaatttccaaacccgtttgttctcagataaaaagcagttttataaacccgcaatctgctccagattcaagcagtaatatttcagcaagaggaggtggtcatgggaagccagcacagcagaggctccctgaccgggaggcctgcctgcttttcaggttgtttcccatgttcagcgtggactgcagaagtggctcacgctcctgtggtgagggcagggtgctccacagacacctccagacccagccaagaactacagggcggcgggctgcggtcagcacgtgtgctcgggacacagcggagtcagggccagagcccttccctccaggaactgatccttgggaaaacagccatgggccaggctgcagtctggttcccagtggggctgcctcagtcctacccccagcaccctcaaaagctggggtgtctgcatgtcccttcacataattgataatggtaccaccttctataataataatataaaataaaaaca

SEQ ID NO: 31488 - DNA, 2439 bp, Homo sapiens
aaggctcctcagccgagcgccgagcggtcgatcgccgtagctcccgcagcctgcgatctccagtctgtggctcctaccagccattgtaggccaataatccgttatggagcatgcctttaccccgttggagcccctgctttccactgggaatttgaagtactgccttgtaattcttaatcagcctttggacaactattttcgtcatctttggaacaaagctcttttaagagcctgtgccgatggaggtgccaaccgcttatatgatatcaccgaaggagagagagaaagctttttgcctgaattcatcaatggagactttgattctattaggcctgaagtcagagaatactatgctactaagggatgtgagctcatttcaactcctgatcaagaccacactgactttactaagtgccttaaaatgctccaaaagaagatagaagaaaaagacttaaaggttgatgtgatcgtgacactgggaggccttgctgggcgttttgaccagattatggcatctgtgaataccttgttccaagcgactcacatcactccttttccaattataataatccaagaggaatcgctgatctacctgctccaaccaggaaagcacaggttgcatgtagacactggaatggagggtgattggtgtggccttattcctgttggacagccttgtatgcaggttacaaccacaggcctcaagtggaacctcacaaatgatgtgcttgcttttggaacattggtcagtacttccaatacctacgacgggtctggtgttgtgactgtggaaactgaccacccactcctctggaccatggccatcaaaagctaacctgttgactggcatccataagtgtgcctctgccttatctcatttctcaacagttcattgctcaacaagaacgattcacctgggtttgcaagaatctaaacctctctaggggaagcccactgggtttaaagatgttagtgtttagataatacaggtaacattataaatgacagatctcaattttatagtagtgggaaagatacatgctaagaaagcaaataagctctattatattcggttggaacctaatgggaatcattccactatacaattcagtactgattattcttcttacattattaatcattccatttatcctagaaaattgtttttaatttgaatcagagaaaactgttgaggttcctcttggagtctagaacatccttaaatgtctaacaacaagggctacctctgagtaccttttagtattagttttctgtatatgatatatattatcttatactgaaaaaaaattcctttcagattggggtgttagaagtgcaccaggtcactctgaccttattactgtctttggtattgtcttaaataaatcaagaatcattgacctaattgttaaatttaaaaataggtagttagcaataggtggaaagagaaatgatgtgaaagataaatgatgattcgtggagccctactcacacattaacccccaaattcaaaagtaagaatgcaaaagtctagagggggtaacagtctgcatcatcatcacaacctaaatggagaaagctgtgcagaggaaacttaagcataaaaattgaattcgtttctgacataccttagactgaaaaactgttggttcatccagaagtgtattcatattaccagaaaatgagtttgtctatggggatacatgaacttcatatactaaggagcctaactccaaagcctgcgttctcatcccagtctgatattcacctaagtttccggacccttttccttagctgtaaaatggaagcggttggactgatggtgtctgaggttctttcccacactgaaattctaaatattgacacttagcagtcatagggctgataatacacacagttactgacttagcctaaacaacctggtgcatcgaaatgtattcacctttcttttgtaaagagaccatcttctatcttctttccacctttctctgttttatgaaaccaactgttgacatacaaaccatgattgaaggagaacctgtccaacatgttttatgtacacaaatccctatgttgctataagaaaagtgaaagtaactgttttcttcttggtgctatgacagtgtgagactcaggttgtctgtagagaatgaaaggagcagtggcccgcgtgattgtggcatttaaggagcagtggcccatgtgactgtggcattttcggcacttttcattactttctgcttgaccggaagttgaggcttagctatgtttccatcttcagtttctgaagactagttatatattccttactagaaatatattcataatatataaaagaaatatatctgtgattttaaaattttgctaccaaagaatgcatgttctgtgtgccctgaaaatgttaccagtgttaataaatggatacttatcaaaaaagaa

SEQ ID NO: 31489 - DNA, 2283 bp, Homo sapiens
aaggctcctcagccgagcgccgagcggtcgatcgccgtagctcccgcagcctgcgatctccagtctgtggctcctaccagccattgtaggccaataatccgttatggagcatgcctttaccccgttggagcccctgctttccactgggaatttgaagtactgccttgtaattcttaatcagcctttggacaactattttcgtcatctttggaacaaagctcttttaagagcctgtgccgatggaggtgccaaccgcttatatgatatcaccgaaggagagagagaaagctttttgcctgaattcatcaatggagactttgattctattaggcctgaagtcagagaatactatgctactaagggatgtgagctcatttcaactcctgatcaagaccacactgactttactaagtgccttaaaatgctccaaaagaagatagaagaaaaagacttaaagggaaagcacaggttgcatgtagacactggaatggagggtgattggtgtggccttattcctgttggacagccttgtatgcaggttacaaccacaggcctcaagtggaacctcacaaatgatgtgcttgcttttggaacattggtcagtacttccaatacctacgacgggtctggtgttgtgactgtggaaactgaccacccactcctctggaccatggccatcaaaagctaacctgttgactggcatccataagtgtgcctctgccttatctcatttctcaacagttcattgctcaacaagaacgattcacctgggtttgcaagaatctaaacctctctaggggaagcccactgggtttaaagatgttagtgtttagataatacaggtaacattataaatgacagatctcaattttatagtagtgggaaagatacatgctaagaaagcaaataagctctattatattcggttggaacctaatgggaatcattccactatacaattcagtactgattattcttcttacattattaatcattccatttatcctagaaaattgtttttaatttgaatcagagaaaactgttgaggttcctcttggagtctagaacatccttaaatgtctaacaacaagggctacctctgagtaccttttagtattagttttctgtatatgatatatattatcttatactgaaaaaaaattcctttcagattggggtgttagaagtgcaccaggtcactctgaccttattactgtctttggtattgtcttaaataaatcaagaatcattgacctaattgttaaatttaaaaataggtagttagcaataggtggaaagagaaatgatgtgaaagataaatgatgattcgtggagccctactcacacattaacccccaaattcaaaagtaagaatgcaaaagtctagagggggtaacagtctgcatcatcatcacaacctaaatggagaaagctgtgcagaggaaacttaagcataaaaattgaattcgtttctgacataccttagactgaaaaactgttggttcatccagaagtgtattcatattaccagaaaatgagtttgtctatggggatacatgaacttcatatactaaggagcctaactccaaagcctgcgttctcatcccagtctgatattcacctaagtttccggacccttttccttagctgtaaaatggaagcggttggactgatggtgtctgaggttctttcccacactgaaattctaaatattgacacttagcagtcatagggctgataatacacacagttactgacttagcctaaacaacctggtgcatcgaaatgtattcacctttcttttgtaaagagaccatcttctatcttctttccacctttctctgttttatgaaaccaactgttgacatacaaaccatgattgaaggagaacctgtccaacatgttttatgtacacaaatccctatgttgctataagaaaagtgaaagtaactgttttcttcttggtgctatgacagtgtgagactcaggttgtctgtagagaatgaaaggagcagtggcccgcgtgattgtggcatttaaggagcagtggcccatgtgactgtggcattttcggcacttttcattactttctgcttgaccggaagttgaggcttagctatgtttccatcttcagtttctgaagactagttatatattccttactagaaatatattcataatatataaaagaaatatatctgtgattttaaaattttgctaccaaagaatgcatgttctgtgtgccctgaaaatgttaccagtgttaataaatggatacttatc

SEQ ID NO: 31490 - DNA, 2806 bp, Homo sapiens
ggcagttaactgccaccaagtggtggttgtatgccatagctctgtaacatgaacagtgtttccaataaactgtccaccgcaaaacccgttaaaaaatgagtgagctccatgagctgaggagctagcagattgccgggattacaaagacaacgagacaggaccctttccttagcaggatttacaatctctcttttaagagcctgtgccgatggaggtgccaaccgcttatatgatatcaccgaaggagagagagaaagattcctctgacagtatcctccaagacctgacatggacaatgtgtgaaaaagcgctcaacctccaacttgaaactctcctcgaggcccccagccaccagtcatctcatcaggacaccgaaagacacccattactgtggagcttccaagggtcttggcaactcttttatcggaaacgagagctttttgcctgaattcatcaatggagactttgattctattaggcctgaagtcagagaatactatgctactaagggatgtgagctcatttcaactcctgatcaagaccacactgactttactaagtgccttaaaatgctccaaaagaagatagaagaaaaagacttaaagaagaaacagtgaaaggaatactgttcaattccaacatcagctgtgtaaccgaggcatcgtaatacttttatgacaagtttcactacctttttgcctgtgccagtgtacctcaaagggatatggttgatgtgatcgtgacactgggaggccttgctgggcgttttgaccagattatggcatctgtgaataccttgttccaagcgactcacatcactccttttccaattataataatccaagaggaatcgctgatctacctgctccaaccaggaaagcacaggttgcatgtagacactggaatggagggtgattggtgtggccttattcctgttggacagccttgtatgcaggttacaaccacaggcctcaagtggaacctcagaacttgtgactacactaggaccacctggatagccaaggataatcccgtcccaagactaatcagattaatcagacttaatcacatctgtaaagttcctcttgccatcaaatgatgtgcttgcttttggaacattggtcagtacttccaatacctacgacgggtctggtgttgtgactgtggaaactgaccacccactcctctggaccatggccatcaaaagctaacctgttgactggcatccataagtgtgcctctgccttatctcatttctcaacagttcattgctcaacaagaacgattcacctgggtttgcaagaatctaaacctctctaggggaagcccactgggtttaaagatgttagtgtttagataatacaggtaacattataaatgacagatctcaattttatagtagtgggaaagatacatgctaagaaagcaaataagctctattatattcggttggaacctaatgggaatcattccactatacaattcagtactgattattcttcttacattattaatcattccatttatcctagaaaattgtttttaatttgaatcagagaaaactgttgaggttcctcttggagtctagaacatccttaaatgtctaacaacaagggctacctctgagtaccttttagtattagttttctgtatatgatatatattatcttatactgaaaaaaaattcctttcagattggggtgttagaagtgcaccaggtcactctgaccttattactgtctttggtattgtcttaaataaatcaagaatcattgacctaattgttaaatttaaaaataggtagttagcaataggtggaaagagaaatgatgtgaaagataaatgatgattcgtggagccctactcacacattaacccccaaattcaaaagtaagaatgcaaaagtctagagggggtaacagtctgcatcatcatcacaacctaaatggagaaagctgtgcagaggaaacttaagcataaaaattgaattcgtttctgacataccttagactgaaaaactgttggttcatccagaagtgtattcatattaccagaaaatgagtttgtctatggggatacatgaacttcatatactaaggagcctaactccaaagcctgcgttctcatcccagtctgatattcacctaagtttccggacccttttccttagctgtaaaatggaagcggttggactgatggtgtctgaggttctttcccacactgaaattctaaatattgacacttagcagtcatagggctgataatacacacagttactgacttagcctaaacaacctggtgcatcgaaatgtattcacctttcttttgtaaagagaccatcttctatcttctttccacctttctctgttttatgaaaccaactgttgacatacaaaccatgattgaaggagaacctgtccaacatgttttatgtacacaaatccctatgttgctataagaaaagtgaaagtaactgttttcttcttggtgctatgacagtgtgagactcaggttgtctgtagagaatgaaaggagcagtggcccgcgtgattgtggcatttaaggagcagtggcccatgtgactgtggcattttcggcacttttcattactttctgcttgaccggaagttgaggcttagctatgtttccatcttcagtttctgaagactagttatatattccttactagaaatatattcataatatataaaagaaatatatctgtgattttaaaattttgctaccaaagaatgcatgttctgtgtgccctgaaaatgttaccagtgttaataaatggatacttatc

SEQ ID NO: 31491 - DNA, 581 bp, Homo sapiens
aaagcttttaacccgacggctcagggaggacaccggtagcaggactagaagcagcacagtggaaaaggccaataatccgttatggagcatgcctttaccccgttggagcccctgctttccactgggaatttgaagtactgccttgtaattcttaatcagcctttggacaactattttcgtcatctttggaacaaagctcttttaagagcctgtgccgatggaggtgccaaccgcttatatgatatcaccgaaggagagagagaaagctttttgcctgaattcatcaatggagactttgattctattaggcctgaagtcagagaatactatgctactaagggatgtgagctcatttcaactcctgatcaagaccacactgactttactaagtgccttaaaatgctccaaaagaagatagaagaaaaagacttaaaggttgatgtgatcgtgacactgggaggccttgctgggcgttttgaccagattatggcatctgtgaataccttgttccaagcgactcacatcactccttttccaattataataatccaagaggaatcgctgatctacctgctccaacc

SEQ ID NO: 31492 - DNA, 2860 bp, Homo sapiens
gcctcaggcatgagacctgtaccagcccccgggagccgtgcggggccaacaatgaggagcagaatgcaaggggcggcctcgctcccctggccaccgcgggggtcgcggcctcccattacatagcgcgtgtctcgagccctggcctgctctcggcaccgccacaacgggcgtaatatggccgctggtgccgggacctgccgggcgcgcggagggtcgggccgaggtccgggatccggaactgctcccggcattcctcgcgagtgtatggcgtgggctcccttccccctctgtgggtcccgcgaggagactctcgggctttgaggtgagacctgaagttccgctggccggtagtgtagcaggaaagggcaggtcctcccgggtcgtgagccagtagcctcctggggtggcaaggtgtagagaggggggcgttgaaaggacacccgctacccggcctgctttctaggggtctctttggattgaggacatcagcagcagtggaagggattttactggagacctgtcactgtcagagccttaaaatatcaccgacggggccttaatgtcaccgaggtagagagaaaagggcagtagccctagagactattgcgacacagtgtgcccctcataagtttttccagggaggggttctgtactgagttgacgccccaggagctgagcaccaggctttgcatccttgggaactcagcaaacgtttgttcagccaattgcaggtagcatggcccagggcttgattgaggtggagcgaaagttccttccagggcctggcacagaggagcggctgcaggagttggggggcaccctggagtaccgggtcaccttccgagacacctactatgacacccctgagctgagcctcatgcaggctgaccactggctgcgacgacgagaggatagtggatgggagctcaaatgtcctggagcagcaggtgtcttaggaccccacacggagtataaggaactcacagcggaacctacaattgtggcccaactctgtaaggtgctgcgggctgacggcctgggggctggagatgtggctgctgtgctgggcccactggggctgcaggaagtagctagttttgtgactaagcggagtgcctggaagctggtgctcttgggagctgatgaagaggagccacagctcagggtggacttggatacagccgactttggctacgctgtgggtgaggtagaggccctggtgcatgaggaggctgaagtaccaactgccctagagaagatccacaggctcagcagcatgcttggtgtgcctgcacaggagacagcaccagccaagctgattgtgtatctacagcgtttccggcctcaagactatcagcgcctgctagaagtgaacagctccagagagaggccacaggagactgaagatcctgaccactgcctgggctaggggtgtcacttcctagaaggggaagggaactctgggtctaacggagtccactcctgggcccactgtgcctctcccctcagtgtcccttctgacagtgactcctctctctccagcgctgcctgtttcttccccctcctctaagctactcttccttgagccctccctggctgcttcctctcgctcatccgtcagatgcaatctgtgggccgcccctctcccctggccgctaagcagcctccattgatttccgctcgtgtttataggatttccacttagccgtgatcagtagttaagcacaggaaaatcccttgccaccccccctcccttggtcgatgccattgattctgccagcggctcctaaaccgccttacagctgagttagaagatgaggagaggcagcagggatttccctgccttgggatgtgggaaacagaagaaaagttgaggaaatggttgggaatcgctgttagaactctagaaattctaatctgactttgccactgtgcccagctctggcccagagggtagagtgcctcctgtggaagtttaggggcaaatttgttccctgacctggagagggttagaaagaaccaacagctgccccctccccgcccccgtgttgagacaggttctcaaggctcaggggaagatgcatacctcctatgtaagaatgctcttcccttgctgttattcatacacactttccacttcaaatatacccaaatatggctttcctcacttctcaggctttattgggctttatttgtgggagaagggggctggtccccagtttttgcagtgcaaagccagagcgccacctgctggtagccctcaggtgtaggttcgaagctgctggggccccctggggtttgggacacaggagaatttcaggctgtgagtggagacagttactgccacgattccacaggcaagttgttcacctcaaagatctcctgcaccgactggtgaaagtggtcgtaggtgaggcgcagctttagccgcaggggggcctaggaataggagagcagggaccagggttagcacccacggcttcttctatccctgggtcttgtcttgggggaactcctgaagctcaccttgttaggattgaggattctgaagagctgggtgataggaaggccaccccgagctggaactgtgttcccactgggggcctgcagctgcagctggagactctgaacacaggagtttaacagagcacagtatggcagtaggtagggctcaggcagcccctctatactcagtggctccacacccttttcctgtaactccccaagtgctgatctccagatgactcaatcccatctcacactgtctcccacccacctcctccacttagtggccttttctcctggagtccccaggccacctctgaactctgatctttacaaaccttgggcacagcagcct

SEQ ID NO: 31493 - DNA, 1779 bp, Homo sapiens
ggggtgcctggctcagcctcaggcatgagacctgtaccagcccccgggagccgtgcggggccaacaatgaggagcagaatgcaaggggcggcctcgctcccctggccaccgcgggggtcgcggcctcccattacatagcgcgtgtctcgagccctggcctgctctcggcaccgccacaacgggcgtaatatggccgctggtgccgggacctgccgggcgcgcggagggtcgggccgaggtccgggatccggaactgctcccggcattcctcgcgagtgtatggcgtgggctcccttccccctctgtgggtcccgcgaggagactctcgggctttgagccaattgcaggtagcatggcccagggcttgattgaggtggagcgaaagttccttccagggcctggcacagaggagcggctgcaggagttggggggcaccctggagtaccgggtcaccttccgagacacctactatgacacccctgagctgagcctcatgcaggctgaccactggctgcgacgacgagaggatagtggatgggagctcaaatgtcctggagcagcaggtgtcttaggaccccacacggagtataaggaactcacagcggaacctacaattgtggcccaactctgtaaggtgctgcgggctgacggcctgggggctggagatgtggctgctgtgctgggcccactggggctgcaggaagtagctagttttgtgactaagcggagtgcctggaagctggtgctcttgggagctgatgaagaggagccacagctcagggtggacttggatacagccgactttggctacgctgtgggtgaggtagaggccctggtgcatgaggaggctgaagtaccaactgccctagagaagatccacaggctcagcagcatgcttggtgtgcctgcacaggagacagcaccagccaagctgattgtgtatctacagcgtttccggcctcaagactatcagcgcctgctagaagtgaacagctccagagagaggccacaggagactgaagatcctgaccactgcctgggctaggggtgtcacttcctagaaggggaagggaactctgggtctaacggagtccactcctgggcccactgtgcctctcccctcagtgtcccttctgacagtgactcctctctctccagcgctgcctgtttcttccccctcctctaagctactcttccttgagccctccctggctgcttcctctcgctcatccgtcagatgcaatctgtgggccgcccctctcccctggccgctaagcagcctccattgatttccgctcgtgtttataggatttccacttagccgtgatcagtagttaagcacaggaaaatcccttgccaccccccctcccttggtcgatgccattgattctgccagcggctcctaaaccgccttacagctgagttagaagatgaggagaggcagcagggatttccctgccttgggatgtgggaaacagaagaaaagttgaggaaatggttgggaatcgctgttagaactctagaaattctaatctgactttgccactgtgcccagctctggcccagagggtagagtgcctcctgtggaagtttaggggcaaatttgttccctgacctggagagggttagaaagaaccaacagctgccccctccccgcccccgtgttgagacaggttctcaaggctcaggggaagatgcatacctcctatgtaagaatgctcttcccttgctgttattcatacacactttccacttcaaatatacccaaatatggctttc

SEQ ID NO: 31494 - DNA, 581 bp, Homo sapiens
attacatagcgcgtgtctcgagccctggcctgctctcggcaccgccacaacgggcgtaatatggccgctggtgccgggacctgccgggcgcgcggagggtcgggccgaggtccgggatccggaactgctcccggcattcctcgcgagtgtatggcgtgggctcccttccccctctgtgggtcccgcgaggagactctcgggctttgaggtagcatggcccagggcttgattgaggtggagcgaaagttccttccagggcctggcacagaggagcggctgcaggagttggggggcaccctggagtaccgggtcaccttccgagacacctactatgacacccctgagctgagcctcatgcaggctgaccactggctgcgacgacgagaggatagtggatgggagctcaaatgtcctggagcagcaggtgtcttaggaccccacacggagtataaggaactcacagcggaacctacaattgtggcccaactctgtaaggtgctgcgggctgacggcctgggggctggagatgtggctgctgtgctgggcccactggggctgcaggaagtagctagttttgtgac

SEQ ID NO: 31495 - DNA, 2539 bp, Homo sapiens
gccccgggagcgcgggcggcgggccccttggtcctcaggcggccgtggcggcggtggcggcggttgggccgaggcaggcggcctcagtggccgaggtggctggacgcgtagcaggtggaaggagggagggagccgcaggcgcagacccacccgccatgaagccccccgcagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacagttcagaggaatatccttgacttcccccagcatgtttccccctccaaggacatccggacagccagcacagaggccgacaagaagctctctgagttcgacgtggagatgagcatgagggaggacgtgtaccagaggatcgtgtggctccaggagaaagttcagaaggactcactgaggcccgaggctgcgcggtacctggagcggctaatcaagctgggccggagaaatgggcttcacctccccagagagactcaggaaaacatcaaacgcatcaagaagaagctgagccttctgtgcatcgacttcaacaagaacctgaacgaggacacgaccttcctgcccttcacgctccaggagctaggagggctccccgaggactttctgaactccctggagaagatggaggacggcaagttgaaggtcaccctcaagtacccccattacttccccctcctgaagaaatgccacgtgcctgagaccaggaggaaagtggaggaggccttcaactgccggtgcaaggaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaac

SEQ ID NO: 31496 - DNA, 1879 bp, Homo sapiens
ttttgtggatcttagtaggcgagtttgaaaacacggagtccaggaatgaggatcgaccgtgtgtccacctttcctggcttccctgccacactgtttgcacagcactcgtagccagcacacgcgtgtgcacatccacacaggtgctcacacaggtgcccacgcacgtgcctgcaggcctgctttgcatgctgctttctgcgtgtccctggcgcctggcacggcgagtcccttggtgcattccgtcgggacaaggagtgtggctgcgtggtccttggaacagaaaagcctcggtgttgcagagaggaccttgaggatcacccaggagttccctcgccgttggctgcctgccatggttccagcgggactcagtcaagggctgtgcttttagggaaggttccacacacacacgagcagggagatgcagcatgcctcacagcgtccccacccggacctggccgtccccaggtcccaacccctcggggtgcggagctttcagggagcagcagctctgtggctagaggagaagcgtgggtggcctccagggacggggtcatgtggccggcatcttcaggtgtgtcctgctgccaccggcagccagcagcagcccaggggcctccgggtcccggtcgttttccagttttggggtgggagggccgggcccagcgcatcacctgtgcactcgccctgtttgcactgtggcagctgacacgggccaggccggcgggaacgggctaggcaggacctgggcactctgaggctctgccccatccctgcaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaagtttcctcactatgaagtgcggccgttacgccatgtgagcctgtgcctcccgctgacttggtgtgacccaggctcgggacagccgccagagtccctcacaaggaacaggtggctaccagctttgagggccggccctgccctgcctgggtgcaacattgcactgggcagcctgcaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaac

SEQ ID NO: 31497 - DNA, 3181 bp, Homo sapiens
attggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacagtgtagttggtgtggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatgatttgggatagaggagcattagttgccatcaatccaggtgatcgcaaatgctatgcagatacaatgttttccctcctgggaaagaagtttcagtatctcctgtgtgttctttcttatgatccaactaaacatccaggtccaccattttatgttccacatgctgaaattgaaaggttgtttggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtcttgcagattgcaagatattttaccaatcagcatgtgttacctgtacaattaaaaaaatatttcaaaatgcaatgcatattaaatataatacacacagaaaaactggcatttattttgttttatttttttgagatggagtttcgttcttgttgcccaacctggagtgcaatggtgcaatctcagctcactgcaacctctgcctcccaggttcaggtgattctcctgcctcagcctcctgagtagctgggattacaggtgtgcgccaccacgcccagctaattttttgtatttttagtagagacagggtttcaccatgttggtcaggctgatctcgagctcctgacctcaggtgatctacccacctcggcctcccaaagtgctgggattacaggcgtgagccactgcacctggcctgacattctttatgaaatttagaattgttgaagaactataacatttcagtagggttcaaggtggtcccaaaagttatataaaagattagtttttactataaacccttgtcttttactcagatcctagcatcccttttcacatggtttctccatgtatataacagaatcaagaaacaaattttaattaaacaatctgtaacagaatcaagaaacaaatacattttaattaaacaatctatatggaacaaacattcccaaattctaagaataaatttttctttaagttttctctgagtttggcaattgttgttttttataatttaatctgtttaaatcatcaggtcttataaaatataatgtacttagagctggattcatggctgtttattatgaaaggttagatttctcagttcttctttaaccacattttgttatatcagacagtcctctataactctgtactacccaacaactaaatggtttagattgtttagctcatgttaataggatggttgtgtattataaaaaacgagttacgtgtgtgtgtgcacgcatgcacgcacatgtgctggcttaaaggttgttaatgcaaggtttggggtcccctttaacactggtgaaagctacggtactctccccagagatatgtcttgtcagcctctctagttccccttggcctgcatgtacaaacttctaccctagaagctctctgccatcgatgtattctaatagatttgtaaggctattaatttgaagcaactccttgctcacagtgattcttgcttctctgagacctgctcccagtcgatactgtgggcttcagaagccatgactccccaactctgcctgtatcaccggttgaatggacaactaacccgagctggaccaacacaattctctccagagacttttgattttacttttatgtagagacagggtctcactttgttgcccacgctgatgttgaacttgacgtgaggcctcaagcagtcctcctgtcttggccacccaaagtgctaggattacaggtatgagccattgcgctggccctcttcataggcttttggacttgggaatagaaaagcaaccccgtctctactaaaaatacaaaaaaattagccaggcgtggtggcacgtgcctgtaatcccagctacttgggaggctgaggcaggagaatcacttgaacctaggaggcggaggttgcagtgagctgagatcatgccactgcacgcaagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatgagatatccttaggtagttgatcatttatgtaatatgtgtcttcactggggaatactgacttcctaaaatctcaagatggaagatataccacatgtaaattattttagagcaattaaattgttttcaggattttccaaaaa

SEQ ID NO: 31498 - DNA, 2396 bp, Homo sapiens
agtgctagtggcggcaggtgcaggtggccgcgcggcatcctggggcttgcagtctcccgagcgttctgttgtgtccctgcctacaattttagggaacctaataaaagggtggtcggtatgtttttatttgggtgtgtacttttgttaggtcgctttttcgctatgcattaagtacggactttaggactcaactagtaccaggaagaaaaagaccggacattttcacctgtttgttatacagcgaaggggaaaaattgggaagaaatcctcaagctacaagaaaaataaccagaagctttacactttagcctgcagtgacttatatcctggtgtcctaagtccacctaagtcagttttgcaataagaggtcccaagtttggttttcttggagcttgcatcagttggttgcatcatccctgagtagaagatttgcggttgcaaggaaaaataaggtacagagcttctccagcgggaaagtgcatgtctgcacggcacgagcccacgcaccgcagaacaggcttgccaggtctcctcagagaccctcgcaggaacctaacaatgaaatccagttgtccagtcttgatttgtggaggggtaaggagaatccgaggccagtgggcaatccgcccactgttgggagcgactgacctcacgaatcaataatttgcttttgactaggaagtgcagcggttcttggggggaggggctggactgggtggcggacgcgaggagcaacggttctcccgaacctctcccccgcccctactatcttggcctacattttcccgctccgtcccgggacctggacacccagaatccacgaaaagcaactcgcgctcgagaacagctctcgtacccttctacgtgatctgcacctttaagctcactccatcccaaaccggaccccggaggcaccacccacatccgtctaacatcacttccttcagagtttgaaaaaaaaaaatctgggaagtagaggtgttgtgctgagcggcgctcggcgaactgtgtggaccgtctgctgggactccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaaggaaa

SEQ ID NO: 31499 - DNA, 2312 bp, Homo sapiens
ggagtttggggatgaggcagctgaagaacagagtcttgtgatggtggaaccaggacttcgttgttccttcattgtgtgggcagaagaggtggaggattttaggcgccacctggtcttgtccccactgcccagacaggcagggaatccctcttcttccttttgctgaatcagctggagaagaaagcccagcaggaggcctgctagcctcagcctcgggccctaccagggtcctaggtactggaatggaacttcgccgaggtcaccgctcaaacggccacaacgagggagccgatttagatcctctgggcctgttccttccttttctttaaacgtcccagtctagcttagaggaggacctgttttgttagataaatggcaagcaaaaaacgagaagtccagttacagacagtcatcaataatcaaagcctgtgggatgagatgttgcagaacaaaggcttaacagtgattgatgtttaccaagcctggtgtggaccttgcagagcaatgcaacctttattcagaaaattgaaaaatgaactgaacgaagacgaaattctgcattttgctgtcgcagaagctgacaacattgtgactttgcagccatttagagataaatgtgaacctgtttttctctttagtgttaatggcaaaattatcgaaaagattcagggtgcaaatgcaccgcttgttaataaaaaagttattaatttgatcgatgaggagagaaaaattgcagcaggtgaaatggctcgacctcagtatcctgaaattccattagtagactcagattcagaagttagtgaagaatcaccatgtgaaagtgttcaggaattatacagtattgctattatcaaaccggatgctgtgattagtaaaaaagttctagaaattaaaagaaaaattaccaaagctggatttattatagaagcagagcataagacagtgctcactgaagaacaagttgtcaacttctatagtcgaatagcagaccagtgtgacttcgaagagtttgtctcttttatgacaagtggcttaagctatattctagttgtatctcaaggaagtaaacacaatcctccctctgaagaaaccgaaccacagactgacaccgaacctaacgaacgatctgaggatcaacctgaggtcgaagcccaggttacacctggaatgatgaagaacaaacaagacagtttacaagaatatctggaaagacaacatttagctcagctctgtgacattgaagaggatgcagctaatgttgctaagttcatggatgctttcttccccgattttaaaaaaatgaaaagcatgaaattagaaaagacattggcattacttcgaccaaatctctttcatgaaaggaaagatgatgttttgcgtattattaaagatgaagacttcaaaatactggagcaaagacaagtagtattatcggaaaaagaagcacaagcactgtgcaaggaatatgaaaatgaagactattttaataaacttatagaaaacatgaccagtggtccatctctagcccttgttttattgagagacaatggcttgcaatactggaaacaattactgggaccaagaactgttgaagaagccattgaatattttccagagagtttatgtgcacagtttgcgatggacagtttgccggtcaaccagttgtatggcagcgattcattagaaaccgctgaaagggaaatacagcatttctttcctcttcaaagcactttaggcttgattaaacctcatgcaacaagtgaacaaagagagcagatcctgaagatagttaaggaggctggatttgatctgacacaggtgaagaaaatgttcctaactcctgagcaaatagagaaaatttatccaaaagtaacaggaaaagacttttataaagatttattggaaatgttatctgtgggtccatctatggtcatgattctgaccaagtggaatgctgttgcagaatggagacgattgatgggcccaacagacccagaagaagcaaaattactttcccctgactccatccgagcccagtttggaataagtaaattgaaaaacattgtccatggagcatctaacgcctatgaagcaaaagaggttgttaatagactctttgaggatcctgaggaaaactaaagtatatactgtgaaaactttgagaagataatacatatgttcacgtcaatatacaaccatttggcacagcttcctgggaggaataataagaaaaacatgctttggaggaaaactcaagatacaaaaatgaatggctatgcataataacaataagaatgtattccccaaacaaa

SEQ ID NO: 31500 - DNA, 1879 bp, Homo sapiens
aaacgtcccagtctagcttagaggaggacctgttttgtgtaaggcttgccggagcaaccagcacctttcctggaatacagtcttgtttgtggcttttcctttgtttagataaatggcaagcaaaaaacgagaagtccagttacagacagtcatcaataatcaaagcctgtgggatgagatgttgcagaacaaaggcttaacagtgattgatgtttaccaagcctggtgtggaccttgcagagcaatgcaacctttattcagaaaattgaaaaatgaactgaacgaagacgaaattctgcattttgctgtcgcagaagctgacaacattgtgactttgcagccatttagagataaatgtgaacctgtttttctctttagtgttaatggcaaaattatcgaaaagattcagggtgcaaatgcaccgcttgttaataaaaaagttattaatttgatcgatgaggagagaaaaattgcagcaggtgaaatggctcgacctcagtatcctgaaattccattagtagactcagattcagaagttagtgaagaatcaccatgtgaaagtgttcaggaattatacagtattgctattatcaaaccggatgctgtgattagtaaaaaagttctagaaattaaaagaaaaattaccaaagctggatttattatagaagcagagcataagacagtgctcactgaagaacaagttgtcaacttctatagtcgaatagcagaccagtgtgacttcgaagagtttgtctcttttatgacaagtggcttaagctatattctagttgtatctcaaggaagtaaacacaatcctccctctgaagaaaccgaaccacagactgacaccgaacctaacgaacgatctgaggatcaacctgaggtcgaagcccaggttacacctggaatgatgaagaacaaacaagacagtttacaagaatatctggaaagacaacatttagctcagctctgtgacattgaagaggatgcagctaatgttgctaagttcatggatgctttcttccccgattttaaaaaaatgaaaagcatgaaattagaaaagacattggcattacttcgaccaaatctctttcatgaaaggaaagatgatgttttgcgtattattaaagatgaagacttcaaaatactggagcaaagacaagtagtattatcggaaaaagaagcacaagcactgtgcaaggaatatgaaaatgaagactattttaataaacttatagaaaacatgaccagtggtccatctctagcccttgttttattgagagacaatggcttgcaatactggaaacaattactgggaccaagaactgttgaagaagccattgaatattttccagagagtttatgtgcacagtttgcgatggacagtttgccggtcaaccagttgtatggcagcgattcattagaaaccgctgaaagggaaatacagcatttctttcctcttcaaagcactttaggcttgattaaacctcatgcaacaagtgaacaaagagagcagatcctgaagatagttaaggaggctggatttgatctgacacaggtgaagaaaatgttcctaactcctgagcaaatagagaaaatttatccaaaagtaacaggaaaagacttttataaagatttattggaaatgttatctgtgggtccatctatggtcatgattctgaccaagtggaatgctgttgcagaatggagacgattgatgggcccaacagacccagaagaagcaaaattactttcccctgactccatccgagcccagtttggaataagtaaattgaaaaacattgtccatggagcatctaacgcctatgaagcaaaagaggttgttaatagactctttgaggatcctgaggaaaactaa

SEQ ID NO: 31501 - DNA, 1637 bp, Homo sapiens
cgggctgctgggcgggaggcgcacgcgcagaactgttcgccacccgaccgcccgccccttcctctggcgtccaaggtgatatcgcgcgaggttcgcagccaataaggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgggaaaacacaagattatgttgttgggtttactgacctaggaaatacagatgacttcaccacagaaactttagaatggaggctcggttcttctgacattcttaattacagtggaaatttaatggagccaccatttcagaaccaaaagaaatttggaacaaacttcacaaagctggaaaagaaaactatccgaggaaagaaatatgattcagactctgatgatgattagagctcaataattctttgtaaattgtctttttttttctgcttcagatttaaatgtgtttttaaaattctattaatgtctatacattggtcacctaaatactcatattctcgagttttatacagttgtatcacatcgaaaagtgtctttactgttttctgtgtggccatcatgtttaagttgaggaaaactcagttcttaaattatctgggaagggtctggattctctatttttgagattgactttatcacaatatgattcttacatctttataccatttacaattgtgttttagatctacagagttagaaattcgaaaactattccaggactaattcttaatcggcattatttatacaagaggtcaagtaacatttactagcgcaatactgcacttgtaaatgaattataaacgctcttctggaatatatttaaataaccattaaagaactgcttattcattctggacactgcatgttgatgttgaatcaactgatgccagcagaaagctattttgatttgtgaacatactgccttatttaaagggtcctgattgcttgtattttaagacattcattaaaaagaaaccaggaaacacttttgaaataacagcataaggaacttcactgtctctgctcaataaaatacctgtaactggaagtttatgtggaaattgtcataaaagcatacatccaacaaaaa

SEQ ID NO: 31502 - DNA, 568 bp, Homo sapiens
acagacaagaataaatatcttgatcactgacacatgctgtacaaataaaattaggaagtcaactctttccatcatgagtaacagaactcaatcgaatgtgacacacagaaatgtctcaaaaatctctagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttcctttgtga

SEQ ID NO: 31503 - DNA, 1014 bp, Homo sapiens
acagacaagaataaatatcttgatcactgacacatgctgtacaaataaaattaggaagtcaactctttccatcatgagtaacagaactcaatcgaatgtgacacacagaaatgtctcaaaaatctctagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgggaaaacacaagattatgttgttgggtttactgacctaggaaatacagatgacttcaccacagaaactttagaatggaggctcggttcttctgacattcttaattacaggtggtggccctagggccgtaggttgctggcccctgttctgaaccaccgagagataccagttcacatgtcctcagttcagcaatgtggggagagatgatcggctggatgatgctattttacagacacccaggacctacagcatgttccaaatgtctacatcaattgagacaggatgttgctatgttgcccaggctggtcttgaagtgccttgacctcctaaagtgttggaaccacagacgtgagccactccacccagcctaaaacttcatcttctttggtaaatgtgcttt

SEQ ID NO: 31504 - DNA, 1893 bp, Homo sapiens
gatggcggcaatggcggtggcgctgcggggattaggagggcgcttccggtggcggacgcaggccgtggcgggcggggtgcggggcgcggcgcggggcgcagcagcaggtcagcgggactatgatctcctggtggtcggcgggggatctggtggcctggcttgtgccaaggaggccgcccagctgggaaggaaggtggccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccatagcaccttgcatctctgcgtgtctccccaccaccgtgggacatgctggaaaaaaccagagaagagactgagacggcatcagccaggtgtcctcatcgaggatcaactaggcaatcatcctcgccttccctggcccttgagcaattgcttattaaggtttcagcacataaatcctacttgtcaccttccaggtttaagtcttggtatgtttcttttctttttttttttttttttgagatggagtctcgctctgtcgcccaggctggagtgcagtggcaacctccgcctcccgggttcaagcgattctcctgcctcagcctcctgggtagctggggctacaggcgcccaccactacacctgactaatttttgtatttttagtagagacggggtttcaccatgtaggccaggatggtctcaatctcctgaccttgtgatccacctgccttggcctcccaaagtactgagattacaggtgtgagccaccgcacctggccagtatgtattttttctttagcatattaaatgttttgctgcttcaggctttccagctaggtttttttctttttttgcgtgtgaaacagggtctctctctgttgcctaggaggagtgtggtggtgtgatcatagctcactgcagcctccacctcccaggctcaatcaatcttcccatctcagccttctaagtgctgggattacaggtttgagctactgtgcccagccaagctagtttgttgtttttaacataaaaatgatatggatttgaaagttttaaaaattatggtgacatacacataacatcaaattcatcatcttaagcattttaaagtatatagttcagtggtgttaagtacgttcatattgtacaagcagcatgaccatccatctctagaacttttccattatctccaaactgagctctgtccccattaaacactcactccctgc

SEQ ID NO: 31505 - DNA, 2025 bp, Homo sapiens
ccggacctcaggcccagttcagtgtacttcccctctctacttcctccctccagtcccttctccatccctcccttttttggctgccccttgcctgccttcctcgccagtagcttgcagagtagacacgatgacaccttttgcaggctaaaaaggctgagagtggcactatgtgcagtgagccaccatggaggaccaagcaggtcagcgggactatgatctcctggtggtcggcgggggatctggtggcctggcttgtgccaaggaggccgcccagctgggaaggaaggtggccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccatagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaagtgtg

SEQ ID NO: 31506 - DNA, 1933 bp, Homo sapiens
cacgacgatggcggcaatggcggtggcgctgcggggattaggagggcgcttccggtggcggacgcaggccgtggcgggcggggtgcggggcgcggcgcggggcgcagcagcaggtcagcgggactatgatctcctggtggtcggcgggggatctggtggcctggcttgtgccaaggaggccgcccagctgggaaggaaggtggccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccatagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaa

SEQ ID NO: 31507 - DNA, 3130 bp, Homo sapiens
atggcggcaatggcggtggcgctgcggggattaggagggcgcttccggtggcggacgcaggccgtggcgggcggggtgcggggcgcggcgcggggcgcagcaggtcagcgggactatgatctcctggtggtcggcgggggatctggtggcctggcttgtgccaaggaggccgcccagctgggaaggaaggtggccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccatagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggtatgcaggtggggctggctctgtttgaggacagggcatgtggcaggggtgcaggagccctggccatgggctccctccaggtgtacagcaaggctacacctgccacgccacccagaatgggtgctccatcctgtaaccaggccacagcggtgacaggcagaaggggaagttcccaggggcccaaacctccccgggggaccccagaccccggcctggccacagctgctccccacacacaggaggtatcaagaaacggggctcatccttagcagcctatcccaggtggatgttggcgtggaaggtgtcccgggtgggctaaagtcgggcatctcaagttgctgccccacagggggctgcagtcgggaagctggcctcccaccgaggcctcccaccaaggcctggctcctgcagagttcagcgcccgctcatttccctatctcccagaaggtggagacgctgccctgtgatggccggccctgcccagcctgccctgcacatctggttctgttccagctctgcagagccaggctgaccggggggcatgttgttcatcgtgacctcttctggggaggaagaaactggcaagggctcctggcctctgccccagggatgcctgtgccagagccccctcgcctcgtggtctaatagtgcatcctccggcctgggctgcagggcaggggccggggcagggtgggccctcagcccgtgccatccagcccacctggggcacccccatggctgtcagcccctcccagggttggggtgtttgggctccatctctcccccggggctgaggtggagaccaggcagagcagtgggctccccccaagatgcctgtggacaggctctagggtctgcatggcgccgaggggctctggggaggcctctctgggggtactcagggccccctgcttcaccgtggccgcctccccccggcggggccgcgctcgatagggataaacaaagggcatcctgaggaaactcttatcagaacattacacctcccagagctgttttgttaggagcctgctataaatttttatcatttcaaaatatttttgtagcaccgcgtcgctccctgtgacgcatcgccctggggtggggccattctctgctgggtttatttctcacccatctcccttgggggtccctgggtgtggcagtgggagacatagctaggctgatgtgaggggtgggtggctgacctgtgctgaccttcctgttgttggcaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgc

SEQ ID NO: 31508 - DNA, 1964 bp, Homo sapiens
ggcagccctagctgccccagaagccccacgacgatggcggcaatggcggtggcgctgcggggattaggagggcgcttccggtggcggacgcaggccgtggcgggcggggtgcggggcgcggcgcggggcgcagcagcaggtcagcgggactatgatctcctggtggtcggcgggggatctggtggcctggcttgtgccaaggaggccgcccagctgggaaggaaggtggccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgctgcctgtcagtgtgtcatatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccatagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaagtgtg

SEQ ID NO: 31509 - DNA, 1929 bp, Homo sapiens
cgacgatggcggcaatggcggtggcgctgcggggattaggagggcgcttccggtggcggacgcaggccgtggcgggcggggtgcggggcgcggcgcggggcgcagcagcaggtcagcgggactatgatctcctggtggtcggcgggggatctggtggcctggcttgtgccaaggaggccgcccagctgggaaggaaggtggccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgtgtgtggtggctcatgcttatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccatagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctg

SEQ ID NO: 31510 - DNA, 1814 bp, Homo sapiens
cgatgacaccttttgcaggctaaaaaggctgagagtggcactatgtgcagtgagccaccatggaggaccaagcaggtcagcgggactatgatctcctggtggtcggcgggggatctggtggcctggcttgtgccaaggaggccgcccagctgggaaggaaggtggccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccatagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgg

SEQ ID NO: 31511 - DNA, 1385 bp, Homo sapiens
gtttgcgtgtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtgagcctgtgcgttttgcatactgggttggtttgctggggctgcggtgacagcatatgccgcgagctgggctttaacagagatgtgtgctctcacagctttgcaggcgggggtctgagatcagggtgtcgcgggtggggggtcactgctgaggccgtgaggggaatctgctcaggcctgtccctggcttctgggggctgctggtggtattttcagttccttggtgtgtggatacttcgccccatctctgccttcacctgtgtcctccctgtgtgggtgctggtgtccaaaatttccccttttcgtagtgacaccagctgtgttggattggggcccaccctgctccagcatggcctaatcttaactaattacatttgcaaggatcttatgtccacaaaagtcacagtctgaggtgctgggggttaggacttcaatatataaattttgcggttacacaattcaatccatgacagaatccaaaggtttactctggttataaaaacagtacaataaaatattgtttatagccttccctgtaagg

SEQ ID NO: 31512 - DNA, 903 bp, Homo sapiens
gcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcagttaccatagaggttggtgaattagctacatgagcattagaccattctccaaaagtggagcctcctactcggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtg

SEQ ID NO: 31513 - DNA, 1211 bp, Homo sapiens
ggcggcgcagggtccccctctggcggtggcgcgatggtgcgcgccgcctggggagctgcggccgggggtttgaaccggccaacttctccagccggccggggcgagcgccagcgcggcgtccggggcgagtgacacgcagagctgaagccatggttcatcaggtgctctaccgggcgctggtctccaccaagtggctggcggagtccatcaggactggcaagctggggcccggcctgcgggtgctggacgcgtcctggtactcaccaggcacccgagaggcccgcaaggagtacctcgagcgccacgtacccggcgcctctttctttgacatagaagagtgccgggacacggcgtcgccctacgagatgatgctgcccagcgaggctggcttcgccgagtatgtgggccgcctgggcatcagcaaccacacgcacgtggtggtgtatgatggtgaacacctgggcagcttctatgctccccgggtctggtggatgttccgtgtgtttggccaccgcaccgtatcagtgctcaatggtggcttccggaactggctgaaggagggccacccggtgacatccgagccctcacgcccagaaccggccgtcttcaaagccacactggaccgctccctgctcaagacctacgagcaggtgctggagaaccttgaatctaagaggttccagctggtggattcaaggtctcaagggcggttcctgggcaccgagccggagccggatgcagtaggactggactcgggccatatccgtggtgccgtcaacatgcctttcatggacttcctgactgaggatggcttcgagaagggcccagaagagctccgtgctctgttccagaccaagaaggtggatctctcgcagcctctcattgccacgtgccgcaagggagtcaccgcctgccacgtggccttggctgcctacctctgcggcaagcctgatgtggccgtgtacgatggctcctggtccgagtggtttcgccgggcccccccagagagccgtgtgtcccagggaaagtctgagaaggcctgagccgtgacctcttctgcttactgtaactgcggccggtttagtgaccccatgacttacagccggttcttacctcttaggtgaaggagatgacatgtttttagaattgctgtgcaaggctcaccctctctctgtcaacactggaataaactttgccttttctgagtagtg

SEQ ID NO: 31514 - DNA, 1797 bp, Homo sapiens
gccgggggtttgaaccggccaacttctccagccggccggggcgagcgccagcgcggcgtccggggcgagtgagtgcggggcgggggcagcggccgggcgcctgggccgccggtcgggccacctgctgcccggggaaggatagcgttgcgagagtgggacggggtgccccgggaacccctgatccacctagggcagagggcagcgagctacgggccggactcgggcactctggaggcgggcgagctcgggctgcctggggaggccgcaggcgatggcgtgtgcgcggctcgcggagcttcctagccgtgcgcccaccccctctgccttggaaggaaaggggattctaagcccaagatgccatcgccccccatcccgggcatgctttcattgctctttcctggcgggatcgagtactgtaacttctaggagccagatccccgccccaggaagcgcccctacttggagtcctcggaaactcttgccccacccgcttctgcgctgggcccccgggccggctgggaggggcggggccggctttccagagggaatctgcaaacttatcccgctgcacgccccagcctcgctggcttgctgtaaacaaggaacccgggggagtgcggagggagaaagagcttctcccaggcctcaccctactgcacacaccgacttccttcctcacgcctgtctctctttcctggttcccacccgtgccaggtgacacgcagagctgaagccatggttcatcaggtgctctaccgggcgctggtctccaccaagtggctggcggagtccatcaggactggcaagctggggcccggcctgcgggtgctggacgcgtcctggtactcaccaggcacccgagaggcccgcaaggagtacctcgagcgccacgtacccggcgcctctttctttgacatagaagagtgccgggacacggcgtcgccctacgagatgatgctgcccagcgaggctggcttcgccgagtatgtgggccgcctgggcatcagcaaccacacgcacgtggtggtgtatgatggtgaacacctgggcagcttctatgctccccgggtctggtggatgttccgtgtgtttggccaccgcaccgtatcagtgctcaatggtggcttccggaactggctgaaggagggccacccggtgacatccgagccctcacgcccagaaccggccgtcttcaaagccacactggaccgctccctgctcaagacctacgagcaggtgctggagaaccttgaatctaagaggttccagctggtggattcaaggtctcaagggcggttcctgggcaccgagccggagccggatgcagtaggactggactcgggccatatccgtggtgccgtcaacatgcctttcatggacttcctgactgaggatggcttcgagaagggcccagaagagctccgtgctctgttccagaccaagaaggtggatctctcgcagcctctcattgccacgtgccgcaagggagtcaccgcctgccacgtggccttggctgcctacctctgcggcaagcctgatgtggccgtgtacgatggctcctggtccgagtggtttcgccgggcccccccagagagccgtgtgtcccagggaaagtctgagaaggcctgagccgtgacctcttctgcttactgtaactgcggccggtttagtgaccccatgacttacagccggttcttacctcttaggtgaaggagatgacatgtttttagaattgctgtgcaaggctcaccctctctctgtcaacactggaataaactttgccttttctgagtagtg

SEQ ID NO: 31515 - DNA, 965 bp, Homo sapiens
aacttctccagccggccggggcgagcgccagcgcggcgtccggggcgagtgacacgcagagctgaagccatggttcatcaggtgctctaccgggcgctggtctccaccaagtggctggcggagtccatcaggactggcaagctggggcccggcctgcgggtgctggacgcgtcctggtactcaccaggcacccgagaggcccgcaaggagtacctcgagcgccacgtacccggcgcctctttctttgacatagaagagtgccgggacacggcgtcgccctacgagatgatgctgcccagcgaggctggcttcgccgagtatgtgggccgcctgggcatcagcaaccacacgcacgtggtggtgtatgatggtgaacacctgggcagcttctatgctccccgggtctggtggatgttccgtgtgtttggccaccgcaccgtatcagtgctcaatggtggcttccggaactggctgaaggagggccacccggtgacatccgagccctcacgcccagaaccggccgtcttcaaagccacactggaccgctccctgctcaagacctacgagcaggtgctggagaaccttgaatctaagaggttccagctggtggattcaaggtctcaagggcggttcctgggcaccgagccggagccggatgcagtaggactggactcgggccatatccgtggtgccgtcaacatgcctttcatggacttcctgactgaggatggctcctggtccgagtggtttcgccgggcccccccagagagccgtgtgtcccagggaaagtctgagaaggcctgagccgtgacctcttctgcttactgtaactgcggccggtttagtgaccccatgacttacagccggttcttacctcttaggtgaaggagatgacatgtttttagaattgctgtgcaaggctcaccctctctctgtcaacactggaataaactttgccttttctg

SEQ ID NO: 31516 - DNA, 451 bp, Homo sapiens
ccgcgccacccggcgtccccctcagacccccgcgggtcccggaggccccgcgcgcgaggtgacacgcagagctgaagccatggttcatcaggtgctctaccgggcgctggtctccaccaagtggctggcggagtccatcaggactggcaagctggggcccggcctgcgggtgctggacgcgtcctggtactcaccaggcacccgagaggcccgcaaggagtacctcgagcgccacgtacccggcgcctctttctttgacatagaagagtgccgggacacggcgtcgccctacgagatgatgctgcccagcgaggctggcttcgccgagtatgtgggccgcctgggcatcagcaaccacacgcacgtggtggtgtatgatggtgaacacctgggcagcttctatgctccccgggtctggtggatgttccgtgtgtttggccaccgcaccgta

SEQ ID NO: 31517 - DNA, 2113 bp, Homo sapiens
aggcgccgcagcgcagtggcgggcacgcgcagccgagaagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaaggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagacgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacattttt

SEQ ID NO: 31518 - DNA, 5609 bp, Homo sapiens
acatccgggcttctgctactagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggagtttcagtctgatggaagcaaacaagaagataaagaaaaaacggaagttatccttagctgtttgcttagcattactgaccaggtactacttccatctctttctttgatggactgcaatgcttgtatgtctgaggaactatggggaatgtttaaaacatttccatatcagcatagatatcgtctgtatggccagtggaagaatgaaacttataacagtcacccacttttagtaaaagttaaagctcaaacaatagacagagccaaatatatcatgaagcgcctaaccaaggaaaatgtgaagccttctggaagacaaattgggaagttgagccacagcaatccaaccattttgtttgattatatcttgtcacaaatacagaagtatgataacttaataacacctgtagtagattcattgaaatacctcacttcactgaattatgatgtcttggcctattgtatcattgaagctttagctaatccagaaaaggaaagaatgaaacatgatgacacaaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttttgattttacctcattttaaaactgttttaatttattatttggcttgttcttaatattagtcactaaaagcagtgggagcattgtcttatgaaatgcttaggaatcattttatatagtacatgtacaacattaaacgtgtttaaaaaagaaaaaggtaccagcgatcacttgtcccttgccattttttcttgtaattatgttagacaaatcttggcggcggggggatcaaaacataattgttttaattctacagctgtaggagctttgtattgctgaactttcatctggaaaagtttcacagtgacatttttaaaagagaatttttttatctgccgaattctaccagtgtaaccttttttctaaataaacaatagttttctcaaatggttgt

SEQ ID NO: 31519 - DNA, 4930 bp, Homo sapiens
acacatccgggcttctgctactagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggagtttcagtctgatggaagcaaacaagaagataaagaaaaaacggaagttatccttagctgtttgcttagcattactgaccaggtactacttccatctctttctttgatggactgcaatgcttgtatgtctgaggaactatggggaatgtttaaaacatttccatatcagcatagatatcgtctgtatggccagtggaagaatgaaacttataacagtcacccacttttagtaaaagttaaagctcaaacaatagacagagccaaatatatcatgaagcgcctaaccaaggaaaatgtgaagccttctggaagacaaattgggaagttgagccacagcaatccaaccattttgtttgattatatcttgtcacaaatacagaagtatgataacttaataacacctgtagtagattcattgaaatacctcacttcactgaattatgatgtcttggcctattgtatcattgaagctttagctaatccagaaaaggaaagaatgaaacatgatgacacaaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggtaatgcacttaatgctttatgtgagatttaaaaagtattttacccatcttaaataaattgtgtttccatcatagtggatacagtgttcagaccct

SEQ ID NO: 31520 - DNA, 2816 bp, Homo sapiens
acatccgggcttctgctactagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggagtttcagtctgatggaagcaaacaagaagataaagaaaaaacggaagttatccttagctgtttgcttagcattactgaccaggtactacttccatctctttctttgatggactgcaatgcttgtatgtctgaggaactatggggaatgtttaaaacatttccatatcagcatagatatcgtctgtatggccagtggaagaatgaaacttataacagtcacccacttttagtaaaagttaaagctcaaacaatagacagagccaaatatatcatgaagcgcctaaccaaggaaaatgtgaagccttctggaagacaaattgggaagttgagccacagcaatccaaccattttgtttgattatgtatgttttgagatcttgtcacaaatacagaagtatgataacttaataacacctgtagtagattcattgaaatacctcacttcactgaattatgatgtcttggcctattgtatcattgaagctttagctaatccagaaaaggaaagaatgaaacatgatgacacaaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgattcctccacagtaa

SEQ ID NO: 31521 - DNA, 1365 bp, Homo sapiens
gggaacaaaaacgccgcaaaattgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttttgattttacctcattttaaaactgttttaatttattatttggcttgttcttaatattagtcactaaaagcagtgggagcattgtcttatgaaatgcttaggaatcattttatatagtacatgtacaacattaaacgtgtttaaaaaagaaaaaggtaccagcgatcacttgtcccttgccattttttcttgtaattatgttagacaaatcttggcggcggggggatcaaaacataattgttttaattctacagctgtaggagctttgtattgctgaactttcatctggaaaagtttcacagtgacatttttaaaagagaatttttttatctgccgaattctaccagtgtaaccttttttctaaataaacaatagttttctcaaatggttgta

SEQ ID NO: 31522 - DNA, 1589 bp, Homo sapiens
ttccgggcgcatgcgtgcggcagcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggtcaaagaaaacaattatcggggacatggggatagtgtggaccagctttgttggcatccaagtaatcctgacctatttgttacggcgtccggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacaggggacaaactatgggaggtacagtgtgagtctccgaccttcacagtggcgtggcaccccaaaaggcctctgctggcatttgcctgtgatgacaaagacggcaaatatgacagcagccgggaagccggaactgtgaagctgtttgggcttcctaatgattcttgagaggaggttgtagggagaggaggccccggcagaggtcttccttcatgtggttagtttggtctgttctctcggagttggtgggcaccctaaatatttgtaagttggtataaattgtaaacgtctctggtcaggctgcgcatttcattcttttgctttgtctgtgtattagctctttccattctttgcccccagcatgagttaactcgcgtggactctgcagtgcgagtagtgaccccaccataccttgtcctctggacctcctgtcttctctgcttctgggtgcatggtagactttgtggcatttgatacaacttggacaatacctagtttggagggaggggaatggaagggcatggaagtttttttaaataattaaaaatatatatatataattttgagaattgagcatttaataaactgacttttgttattatggaacttc

SEQ ID NO: 31523 - DNA, 2560 bp, Homo sapiens
gggcagtggggctgggagatggggcggggctgggcgctccgggactgaggtgctgatcgcccaaagggcgcccctgggctggggtctgacccggcttctcctccctcactacccgcggtccccggcctctcggcgctgcgctgttacctcatccgaaaagtgttcgctgcagcatcctcaggcttcacgttggagcctcttgattgtggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgataagacgttatctgtggcaatcgaaggcagtgtggatgaagccaaggctctgttcaaacctccagaggactcccaagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacagttgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctgaccagtggcctttgtctgtggttcctggcaaggtggctttgcagtctggaagggcaggtgggagctgtgacacagtgtgaaaaagcatttgtagagagactttttctcagcagccaataaaagcagagtggaaaaagattccaattctgcagagagatgctc

SEQ ID NO: 31524 - DNA, 2676 bp, Homo sapiens
gggcagtggggctgggagatggggcggggctgggcgctccgggactgaggtgctgatcgcccaaagggcgcccctgggctggggtctgacccggcttctcctccctcactacccgcggtccccggcctctcggcgctgcgctgttacctcatccgaaaagtgttcgctgcagcatcctcaggcttcacgttggagcctcttgattgtggtgttcagcattatttaagatcacctatgcatcatctgaagccacagtcccaggtcatcttcatcaccttccccagtggaatgcctcctgtgttaaagcccacaacaacccctgtggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgataagacgttatctgtggcaatcgaaggcagtgtggatgaagccaaggctctgttcaaacctccagaggactcccaagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacagttgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctgaccagtggcctttgtctgtggttcctggcaaggtggctttgcagtctggaagggcaggtgggagctgtgacacagtgtgaaaaagcatttgtagagagactttttctcagcagccaataaaagcagagtggaaaaagattccaattctgcagagagatgctc

SEQ ID NO: 31525 - DNA, 2374 bp, Homo sapiens
cccttccttacttccggttctctatggtgcgcgggcaagctttgctccgcctccggcagtggcttactcccggtgccaggttcttggagctgtgaggtgttcagcattatttaagatcacctatgcatcatctgaagccacagtcccaggtcatcttcatcaccttccccagtggaatgcctcctgtgttaaagcccacaacaacccctgtggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgataagacgttatctgtggcaatcgaaggcagtgtggatgaagccaaggctctgttcaaacctccagaggactcccaagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacagttgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaag

SEQ ID NO: 31526 - DNA, 738 bp, Homo sapiens
aacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcagtctcaccacgccaccacctccctcgggggcctccgcgctgagcttccggcctctacgcctcgcttccggtcggccgccccttccttacttccggttctctatggtgcgcgggcaagctttgctccgcctccggcagtggcttactcccggtgccaggttcttggagctgtgaggtgttcagcattatttaagatcacctatgcatcatctgaagccacagtcccaggtcatcttcatcaccttccccagtggaatgcctcctgtgttaaagcccacaacaacccctgtggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgc

SEQ ID NO: 31527 - DNA, 729 bp, Homo sapiens
gagctgtgaggtgaggaggggacaagggcagtggggctgggagatggggcggggctgggcgctccgggactgaggtgctgatcgcccaaagggcgcccctgggctggggtctgacccggcttctcctccctcactacccgcggtccccggcctctcggcgctgcgctgttacctcatccgaaaagtgttcgctgcagcatcctcaggcttcacgttggagcctcttgattgtggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagttt

SEQ ID NO: 31528 - DNA, 1006 bp, Homo sapiens
gggcagtggggctgggagatggggcggggctgggcgctccgggactgaggtgctgatcgcccaaagggcgcccctgggctggggtctgacccggcttctcctccctcactacccgcggtccccggcctctcggcgctgcgctgttacctcatccgaaaagtgttcgctgcagcatcctcaggcttcacgttggagcctcttgattgtggtgttcagcattatttaagatcacctatgcatcatctgaagccacagtcccaggtcatcttcatcaccttccccagtggaatgcctcctgtgttaaagcccacaacaacccctgtggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaagga

SEQ ID NO: 31529 - DNA, 4753 bp, Homo sapiens
gcttccggtcggccgccccttccttacttccggttctctatggtgcgcgggcaagctttgctccgcctccggcagtggcttactcccggtgccaggttcttggagctgtgaggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgataagacgttatctgtggcaatcgaaggcagtgtggatgaagccaaggctctgttcaaacctccagaggactcccaagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacagttgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctgaccagtggcctttgtctgtggttcctggcaaggtggctttgcagtctggaagggcaggtgggagctgtgacacagtgtgaaaaagcatttgtagagagactttttctcagcagccaataaaagcagagtggaaaaagattccaattctgcagagagatgctcacctcttgtctacgcacaccctatttgtgctttgcggggtgaggtcctcatgatcttgtatttattatcccaagttcctgctgttaagaggtggtaggagaagccaaaggcagcagagcacaaaaagcaaaactcttccctccccacccgctcttcccattagtcctgtcagggttgccgatggacaaattgtctctgatcgttggatgttataaatgtctgacagtgcagtgcaaacagaagacaaactcagttgatccttgaacaactcaggggttaggggcaccaacaccccctgccctgcacagttgaaaaatccgtgtataacttttgactccctaaaaacttaactaatagcctgctgttgaccagtagtatgctattagtagttacttactgctaacatagtcagtacatattttcagtatatattttgtatcttatacactgtattcttacaatacagtaaactagagaaaagaaaatgttataaggaaagtcacaagggggcctgagtgcagtggctcacgtctgtaatcccagcactttgggaggccaaggcgggtggatcacttgaggtcaggagtttgagaccagcctggccgacatggtgaaaccctgtctctactaaaaacatggaaattagccaagcgtggtggcgcatgcctgtagtcccagttactcaggaggctgaggcagaattacttgaacccatgaggcagaggttgcagtaagccaagatcacgctcctgcgctccggcttgggcgagagtgagactccgtctcaaaaataaataaataagaaagccataaggaagaaaatatatatctactattaagtagaagtggatcaccataaaggtcttcacatactgtctcagggttgaatagtctaaggaagaggaggggttggtcttggtgtctcagggatggcagaggcagaaaaagtgggggaggtggagggggaggcaggcaccactgttatttttattgaacaaaatctgtgcagggactcatgactgtaatcctagtactttggaaagctaaggcgggaggatcccttgaggccaggagttcaggtccagcctgggcaacgtagtgagagaccctgtatctacaaaaaatttaaaaatcagccaggtgtggtggtatgcaccaatagtcccagttactcagaaggctgaggtgggcggatgactggagtccaggagttcaaggtagcagtgagctattcatcgtgcctgtactgtactccagcctgggaaacaatgcgagtccctatctctaaaaaattttaaaaaaagaaatctgcatataatagacccacagagtccaaactattgttcagagatcaactgtacttcacagagagtaattctaagtcttacaggatttcatggagatggcgagagtggtgttggagaatcaatcacatacagagatacaggacagtgagaccaggtaacatttgaggagaatattttttttttattgagacagggtcttgctctgttgtccaggctggagtgcagtggcacgaacacagctcactgccgcctcaacctctcctgggttcaagtgatcctcctgcctcagcctcccaagtagctgggaccacaggtgtgtgccaccatttctggctaatttttaaattttttgtagaggcgggatcccactatttttcccaggctggtctcaaactcctgggctcaaatgatcctcccacctcggcctcccaaagtgctaggattataggcatgagccaccacacccggcctgagtagagtctttaaggtaatgacaaaagtgcctcaaaatataattatttgattaagagaagtcttgggaagataggtaacaacctttaaaatgttcataaaattacatcctttgtaatactcctgcaagtcaaagtaaaggatggcatagactattcttggacagttttgtcaaaaagtgtatcttgaccccaccatcagtactccattcttcattttaaaaaataagatgggctgggcacagtggcttacgcctttaatatcagtactttgggaggctggtgggcggatcacctgagatcaggagttcaagaccagcctggccaacatggtgaaaccccgtctctactaaaaatacaaaaattagctgggcatggtggtgcgcgcctgtaatcccagccactcgggaggctgaggcaggagaattgcttgaatccccgaggcggaggttgcactgagccgagatggtgccactgcaccatctggacaacagagcaagactccgtcttgg

SEQ ID NO: 31530 - DNA, 990 bp, Homo sapiens
gcctcctcctccatggctgtttacccggctgcattgtgggagtttgacctccgccgccgccaaccgccgcctcagcttgcgccgccgccgccgccgccgccgccgcgcacgccatgggagccgtgactgacgacgaagttatacggaagcgtctcctcattgatggagatggtgctggagatgatcggagaattaatctgctagtgaagagtttcattaaatggtgcaactctgggtcccaggaagagggatatagccagtaccaacgtatgctgagcacgctgtctcaatgtgaattttcaatgggcaaaactttactagtatatgatatgaatctcagagaaatggaaaattatgaaaaaatttacaaggaaatagaatgtagcatagctggagcacatgaaaaaattgctgagtgcaaaaagcaaattcttcaagcaaaacgaatacgaaaaaatcgccaagaatatgatgctttggcaaaagtgattcagcaccatccagacaggcatgagacattaaaggaactagaggctctgggaaaagaattagagcatctttcacacattaaagaaagtgttgaagataagctggaattgagacggaaacagtttcatgttcttcttagtaccatccatgaacttcagcaaacattggaaaatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagttttggcagtaaaatactctgtttttaagtatgaatgtatttcattcatatttcctctcacaaaggaaaatgacttcagtatagatttgtttttattaaaatgcattttttattcttaagtggtaggaagcaacatccaaaaatgcttaataaaatgcttttaagctgca

SEQ ID NO: 31531 - DNA, 2262 bp, Homo sapiens
atgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaaatccccagaggccaacctaaaaagccggctttagttacgatgactacagttcccacgtgcgcaactctgcccttggctcaaggattccgtgatgttcattttggttttctaagcgagaggctccgagccttccaacctctgactggctggtcctgtgagacccctcgatcagggatgctgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagctgggggcgggctgcggccgctgattaaaggccgcctagagcagcctgtgtggcgacaggtgcccagaagcccaggaagccggtcagtgcccgccccagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 31532 - DNA, 1982 bp, Homo sapiens
atgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 31533 - DNA, 2116 bp, Homo sapiens
atgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagctgggggcgggctgcggccgctgattaaaggccgcctagagcagcctgtgtggcgacaggtgcccagaagcccaggaagccggtcagtgcccgccccagtcctcagggtttgtgcctctcgctcggacagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 31534 - DNA, 1255 bp, Homo sapiens
caccttggtcacactccagagctcgcttcatccccacgagcggcacctgatctccagtgacggggagactgaggcctggcaaagaggacctgttgcctttgtgtaactggccccagcatgggggaggcattggccccagcatgggggaggcattgaccccaggcctgccaggcctggcagccacagcctggctaggtggaggttactgccttccgcaccactctggcttcctccccgtgcctgtgaagagctcggggcctgcttcctaatttgtaaacacggggcgtgtgtctcagtggctgtgagctagcgagggggtggcgagcgagccggctgcgcaggtcctgaggccccaggcctcattgttggccaacaggcagctgggggcgggctgcggccgctgattaaaggccgcctagagcagcctgtgtggcgacaggtgcccagaagcccaggaagccggtcagtgcccgccccagtcctcagggtttgtgcctctcgctcggacagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 31535 - DNA, 1864 bp, Homo sapiens
atgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 31536 - DNA, 907 bp, Homo sapiens
tggcctacgccaaagcacaggatggggcgggcaggaagccctctcccaagatcgagttggccgaggatggatgattgtggcagcagaagccgttgcagccccacgttgtgctctagtaggtgacaggagtggggctgacgctcccagagccaaaggtcacagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 31537 - DNA, 861 bp, Homo sapiens
tggcctacgccaaagcacaggatggggcgggcaggaagccctctcccaagatcgagttggccgaggatggatgattgtggcagcagaagccgttgcagccccacgttgtgctctagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 31538 - DNA, 907 bp, Homo sapiens; identical to SEQ ID NO: 31536

SEQ ID NO: 31539 - DNA, 4314 bp, Homo sapiens
ggtcagcggagagtaggcatgtagcttctgcagttgctcctcctcaccctccgcgacctgatttcctagaagggctctgtcacccgaaaagattttccactggcttagaggagggagggcccgccttcccccgttatccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagtcaaggcctggccgacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaacaagttcaaatgccggatattgaatgaaaaggtgaatactccaactaccacagtctatagatgtggccctttgatagatctctgccggggtcctcatgttagacacacgggcaaaattaaggctttaaaaatacacaaaaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggaccaagaactatatttctttcatgaactcagccctggaagttgcttttttctgccaaaaggagcctacatttataatgcacttattgaattcattaggagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactgccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcagattgaagatgaaataaaaggttgtttggattttctacgtacggtatatagcgtatttggattttcttttaaactaaacctttctactcgcccggaaaaattccttggagatatcgaagtatgggatcaagctgagaaacaacttgaaaacagtctgaatgaatttggtgaaaagtgggagttaaactctggagatggagctttctatggcccaaagattgacatacagattaaagatgcgattgggcggtaccaccagtgtgcaaccatccagctggatttccagttgcccatcagatttaatcttacttatgtaagccatgatggtgatgataagaaaaggccagtgattgttcatcgagccatcttgggatcagtggaaagaatgattgctatcctcacagaaaactatgggggcaaatggcccttttggctgtcccctcgccaggtaatggtagttccagtgggaccaacctgtgatgaatatgcccaaaaggtacgacaacaattccacgatgccaaattcatggcagacattgatctggatccaggctgtacattgaataaaaagattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacataagtttcaagactgctctgtccctcacatgtacacatacatgcctgagacagataatgtggttcagtatttatctttacagttttacagcaaatataatgcagggtggatggagacggggtaggtctgcagcatcataatgctattcataaactgggtgtgagctgggtgctggcttctcagaggataaacacttttgggagtgtcatttttacttaatgttggatggacaccttttcaaacaaaaactaccatggatctattacagagtagatttgcacaaatgtttaagataaaacgtgaatcttcagagaaatatctgtttatggcagactgttctggaccatagaatcacttggtttacaaattccctattttctcataagggatcattttcaaaatcttctaccaataaatggtgattgaaaggacagcacaaagtaaataatttcttatgtggataaatactaattcctccttgttagaatgatattttaaaagtaacatcttttttttaattttttttgagacaagatcctttgtcccccaggctggagtgtggtgccatgatctcggctcactgcaacctcagcctcccaagtaggtgggactaaagacatgtgccaccatgcctggctgatgtttgtattttctatagagatggtttcatcatgttgcccaggctggtatcaaactcctggataaaagagacccacctgcctcagtctcccaaagtgctgggattacaggtgtgagccaccacgcccagcctaaaaagcaacatcttgtcagtgctataatctcaaatagcttgtttgcaaggtgtgatggttaatactaagtgtcaacttgattggattaaaggatgcctttattgtttctgggtgtgtctgtgagggtgttgccagagagattgacatttgagtcagtggcctgggagaggcagacacaccctctgtgtgcgtgggcaccatccagtcggctgccagtgcagctagaacaaagcgggtggaagaaagtgggattaagttggcttgctgagtcttctggctttcatctttctcctgtgctggatgattcctgcccttggacatcagactccaggttcttcagcttttggactcttggacttatacccgtggtttgccaggggccttctggcctttggccattgactggagatggcactgtcggcttccctgcttttgaggcttggactcggactgaaccactactggcttccttgctccttagcttgcagacagcctatcgtgggacttcaccgtgtgcttgtgtgagtcaattcttactaaatttcctttcatatatacatatatcctattctgtctctctggagaaccctgactaatacacaagggtcacttcaaagagaagctaatttgcatagattaattttcactttaataaaggagctaagatctttaatcata

SEQ ID NO: 31540 - DNA, 2475 bp, Homo sapiens
tggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaacaagttcaaatgccggatattgaatgaaaaggtgaatactccaactaccacagtctatagatgtggccctttgatagatctctgccggggtcctcatgttagacacacgggcaaaattaaggctttaaaaatacacaaaaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggaccaagaactatatttctttcatgaactcagccctggaagttgcttttttctgccaaaaggagcctacatttataatgcacttattgaattcattaggagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactgccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcagattgaagatgaaataaaaggttgtttggattttctacgtacggtatatagcgtatttggattttcttttaaactaaacctttctactcgcccggaaaaattccttggagatatcgaagtatgggatcaagctgagaaacaacttgaaaacagtctgaatgaatttggtgaaaagtgggagttaaactctggagatggagctttctatggcccaaagattgacatacagattaaagatgcgattgggcggtaccaccagtgtgcaaccatccagctggatttccagttgcccatcagatttaatcttacttatgtaagccatgatggtgatgataagaaaaggccagtgattgttcatcgagccatcttgggatcagtggaaagaatgattgctatcctcacagaaaactatgggggcaaatggcccttttggctgtcccctcgccaggtaatggtagttccagtgggaccaacctgtgatgaatatgcccaaaaggtacgacaacaattccacgatgccaaattcatggcagacattgatctggatccaggctgtacattgaataaaaagattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgt

SEQ ID NO: 31541 - DNA, 2523 bp, Homo sapiens
gattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagtcacacagcttcctgcaaaaacctctcttcacttgcatctctgcttgcatctgtggccattccctcatctggaatgccatggcctcctcttttcttccttcaaggcctggccgacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaacaagttcaaatgccggatattgaatgaaaaggtgaatactccaactaccacagtctatagatgtggccctttgatagatctctgccggggtcctcatgttagacacacgggcaaaattaaggctttaaaaatacacaaaaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggaccaagaactatatttctttcatgaactcagccctggaagttgcttttttctgccaaaaggagcctacatttataatgcacttattgaattcattaggagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactgccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcagattgaagatgaaataaaaggttgtttggattttctacgtacggtatatagcgtatttggattttcttttaaactaaacctttctactcgcccggaaaaattccttggagatatcgaagtatgggatcaagctgagaaacaacttgaaaacagtctgaatgaatttggtgaaaagtgggagttaaactctggagatggagctttctatggcccaaagattgacatacagattaaagatgcgattgggcggtaccaccagtgtgcaaccatccagctggatttccagttgcccatcagatttaatcttacttatgtaagccatgatggtgatgataagaaaaggccagtgattgttcatcgagccatcttgggatcagtggaaagaatgattgctatcctcacagaaaactatgggggcaaatggcccttttggctgtcccctcgccaggtaatggtagttccagtgggaccaacctgtgatgaatatgcccaaaaggtacgacaacaattccacgatgccaaattcatggcagacattgatctggatccaggctgtacattgaataaaaagattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacct

SEQ ID NO: 31542 - DNA, 2534 bp, Homo sapiens
atgattgttccacataaagtcagaagggaggaaaggcgcacgcgcattggggacttgactctggaaagcgtccagaccaaggtcagcggagagtaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagtcaaggcctggccgacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaacaagttcaaatgccggatattgaatgaaaaggtgaatactccaactaccacagtctatagatgtggccctttgatagatctctgccggggtcctcatgttagacacacgggcaaaattaaggctttaaaaatacacaaaaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggaccaagaactatatttctttcatgaactcagccctggaagttgcttttttctgccaaaaggagcctacatttataatgcacttattgaattcattaggagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactgccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcagattgaagatgaaataaaaggttgtttggattttctacgtacggtatatagcgtatttggattttcttttaaactaaacctttctactcgcccggaaaaattccttggagatatcgaagtatgggatcaagctgagaaacaacttgaaaacagtctgaatgaatttggtgaaaagtgggagttaaactctggagatggagctttctatggcccaaagattgacatacagattaaagatgcgattgggcggtaccaccagtgtgcaaccatccagctggatttccagttgcccatcagatttaatcttacttatgtaagccatgatggtgatgataagaaaaggccagtgattgttcatcgagccatcttgggatcagtggaaagaatgattgctatcctcacagaaaactatgggggcaaatggcccttttggctgtcccctcgccaggtaatggtagttccagtgggaccaacctgtgatgaatatgcccaaaaggtacgacaacaattccacgatgccaaattcatggcagacattgatctggatccaggctgtacattgaataaaaagattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattc

SEQ ID NO: 31543 - DNA, 466 bp, Homo sapiens
gcattggggacttgactctggaaagcgtccagaccaaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagtcaaggcctggccgacaacaccgttattgctaaagtaaataatgttgtgtgggacctg

SEQ ID NO: 31544 - DNA, 2458 bp, Homo sapiens
cgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagtcaaggcctggccgacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaacaagttcaaatgccggatattgaatgaaaaggtgaatactccaactaccacagtctatagatgtggccctttgatagatctctgccggggtcctcatgttagacacacgggcaaaattaaggctttaaaaatacacaaaaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggaccaagaactatatttctttcatgaactcagccctggaagttgcttttttctgccaaaaggagcctacatttataatgcacttattgaattcattaggagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactgccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcagattgaagatgaaataaaaggttgtttggattttctacgtacggtatatagcgtatttggattttcttttaaactaaacctttctactcgcccggaaaaattccttggagatatcgaagtatgggatcaagctgagaaacaacttgaaaacagtctgaatgaatttggtgaaaagtgggagttaaactctggagatggagctttctatggcccaaagattgacatacagattaaagatgcgattgggcggtaccaccagtgtgcaaccatccagctggatttccagttgcccatcagatttaatcttacttatgtaagccatgatggtgatgataagaaaaggccagtgattgttcatcgagccatcttgggatcagtggaaagaatgattgctatcctcacagaaaactatgggggcaaatggcccttttggctgtcccctcgccaggtaatggtagttccagtgggaccaacctgtgatgaatatgcccaaaaggtacgacaacaattccacgatgccaaattcatggcagacattgatctggatccaggctgtacattgaataaaaagattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgt

SEQ ID NO: 31545 - DNA, 2110 bp, Homo sapiens
actggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggtccaagtacagaatatggcttttaccatgatttcttcctgggaaaggagaggtgtggcacattggttgacctttgccagggcccccaccttcggcatactggacagattggaggactgaagctgctatcggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgaggctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactgtgtggaggcacatgtctgctctcctgaaaagagacttggtttggggaccccacaaaaggagggaagctgtagctgtttggatgtgaggagaatgaaactacaaaaaaaaataaattgggccaggcgcagtggctcatgcctgtaatcccagcactctgggaggctgaggcggacggatcatgaggtcaggagatcaagaccaccctggctaacacggtgaaaccctgtctctactaaaaatacaaaaaattagccgggcatggtggcacacgcctgtaatcccagctactcaggaggctgaggcaggagaatcgcttgaacccgggaggtagaggttgcagtgagctgagattgcgccactgcacccccctaggcgacagagcgagactctgtctctaaataaataaataaataaataaatacaaactggaa

SEQ ID NO: 31546 - DNA, 2106 bp, Homo sapiens
actggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagaggtccaagtacagaatatggcttttaccatgatttcttcctgggaaaggagaggtgtggcacattggttgacctttgccagggcccccaccttcggcatactggacagattggaggactgaagctgctatcggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgaggctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactgtgtggaggcacatgtctgctctcctgaaaagagacttggtttggggaccccacaaaaggagggaagctgtagctgtttggatgtgaggagaatgaaactacaaaaaaaaataaattgggccaggcgcagtggctcatgcctgtaatcccagcactctgggaggctgaggcggacggatcatgaggtcaggagatcaagaccaccctggctaacacggtgaaaccctgtctctactaaaaatacaaaaaattagccgggcatggtggcacacgcctgtaatcccagctactcaggaggctgaggcaggagaatcgcttgaacccgggaggtagaggttgcagtgagctgagattgcgccactgcacccccctaggcgacagagcgagactctgtctctaaataaataaataaataaataaatacaaact

SEQ ID NO: 31547 - DNA, 628 bp, Homo sapiens
aggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagaggggaaagcagtaagtttctttcttatcaggaatacagtgactactaaaccaagagatattgaagcaggaaattctaacattttattcttttgccgcagtttctccatttgcagttgggagggagacctaccacagactgtcttgactatttctggttaggaaacttatggtgaaagtttttaacttagcttcgatctattaagcaaacatttgtgctagtgagagggaga

SEQ ID NO: 31548 - DNA, 1998 bp, Homo sapiens
aatctgtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagaggggaaagcagtgttctggcactccagcacccatgtcctgggggcagcagctgaacaattcctaggtgctgttctctgcagaggtccaagtacagaatatggcttttaccatgatttcttcctgggaaaggagaggacaatccggggctcagagctgcctgttttggagcggatttgccaggaacttacagctgctgctcgacccttccggaggctagaggcttcacgggatcagcttcgccagttgttcaaggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgaggctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactgtgtggaggcacatgtctgctctcctgaaaagagacttggtttggggaccccacaaaaggagggaagctgtagctgtttggatgtgagg

SEQ ID NO: 31549 - DNA, 2729 bp, Homo sapiens
ctgtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagaggggaaagcagtgttctggcactccagcacccatgtcctgggggcagcagctgaacaattcctaggtgctgttctctgcagaggtccaagtacagaatatggcttttaccatgatttcttcctgggaaaggagaggacaatccggggctcagagctgcctgttttggagcggatttgccaggaacttacagctgctgctcgacccttccggaggctagaggcttcacgggatcagcttcgccagttgttcaaggataacccctttaagcttcacttgattgaggagaaagtgacaggtccaacagcaacagtatatgggtgtggcacattggttgacctttgccagggcccccaccttcggcatactggacagattggaggactgaagctgctatcgaactcatcatccttatggaggtcttcaggggccccagagacactgcagagagtgtcagggatttccttccccacaacagaattgctgagggtctgggaagcatggagggaggaagcagaattgcgggaccaccggcgcattgggaaggaacaggagctcttcttcttccatgaactgagccctgggagctgcttcttcctgccacgagggacaagggtgtataatgcactagtggcgtttatcagggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgaggctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactgtgtggaggcacatgtctgctctcctgaaaagagacttggtttggggaccccacaaaaggagggaagctgtagctgtttggatgtgaggagaatgaaactacaaaaaaaaataaattgggccaggcgcagtggctcatgcctgtaatcccagcactctgggaggctgaggcggacggatcatgaggtcaggagatcaagaccaccctggctaacacggtgaaaccctgtctctactaaaaatacaaaaaattagccgggcatggtggcacacgcctgtaatcccagctactcaggaggctgaggcaggagaatcgcttgaacccgggaggtagaggttgcagtgagctgagattgcgccactgcacccccctaggcgacagagcgagactctgtctctaaataaataaataaataaataaatacaaactggaa

SEQ ID NO: 31550 - DNA, 1474 bp, Homo sapiens
gataatctgtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagaggggaaagcagacaatccggggctcagagctgcctgttttggagcggatttgccaggaacttacagctgctgctcgacccttccggaggctagaggcttcacgggatcagcttcgccagttgttcaaggataacccctttaagcttcacttgattgaggagaaagtgacaggtccaacagcaacagtatatgggtgtggcacattggttgacctttgccagggcccccaccttcggcatactggacagattggaggactgaagctgctatcgaactcatcatccttatggaggtcttcaggggccccagagacactgcagagagtgtcagggatttccttccccacaacagaattgctgagggtctgggaagcatggagggaggaagcagaattgcgggaccaccggcgcattgggaaggaacaggagctcttcttcttccatgaactgagccctgggagctgcttcttcctgccacgagggacaagggtgtataatgcactagtggcgtttatcagggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaa

SEQ ID NO: 31551 - DNA, 10583 bp, Homo sapiens
attctgcgaggaatggcagcggcagcagcatccccgccagaggcggcggcggcggcggcagcggccacggccaccaccgcggacgctattgttccctggtgttagacgcgctctccctccttctcatctgaagcgaacaatagcaggaaagagctttgctttctgtactctttgaaaagacgttccaagagcggagaaaaattccctgccgagcgtgctacggctctggaccctggagtggctgcaggcggcatggggctgcaagccaggcgctgggcgtccgggagccggggcgctgcggggccgcgccggggcgtcctgcagctgctgccgctgccgctgccgctgccgctgctcctgctgctgctgctacgcccgggcgccggcagggctgcggcgcagggcgaggcggaggcgcccaccctctatctgtggaagactggtccatggggccgatgtatgggagatgaatgtggtcccggaggcatccaaacgagggctgtgtggtgtgctcatgtggagggatggactacactgcatactaactgtaagcaggccgagagacccaataaccagcagaattgtttcaaagtttgcgattggcacaaagagttgtacgactggagactgggaccttggaatcagtgtcagcccgtgatttcaaaaagcctagagaaacctcttgagtgcattaagggggaagaaggtattcaggtgagggagatagcgtgcatccagaaagacaaagacattcctgcggaggatatcatctgtgagtactttgagcccaagcctctcctggagcaggcttgcctcattccttgccagcaagattgcatcgtgtctgaattttctgcctggtccgaatgctccaagacctgcggcagcgggctccagcaccggacgcgtcatgtggtggcgcccccgcagttcggaggctctggctgtccaaacctgacggagttccaggtgtgccaatccagtccatgcgaggccgaggagctcaggtacagcctgcatgtggggccctggagcacctgctcaatgccccactcccgacaagtaagacaagcaaggagacgcgggaagaataaagaacgggaaaaggaccgcagcaaaggagtaaaggatccagaagcccgcgagcttattaagaaaaagagaaacagaaacaggcagaacagacaagagaacaaatattgggacatccagattggatatcagaccagagaggttatgtgcattaacaagacggggaaagctgctgatttaagcttttgccagcaagagaagcttccaatgaccttccagtcctgtgtgatcaccaaagagtgccaggtttccgagtggtcagagtggagcccctgctcaaaaacatgccatgacatggtgtcccctgcaggcactcgtgtaaggacacgaaccatcaggcagtttcccattggcagtgaaaaggagtgtccagaatttgaagaaaaagaaccctgtttgtctcaaggagatggagttgtcccctgtgccacgtatggctggagaactacagagtggactgagtgccgtgtggaccctttgctcagtcagcaggacaagaggcgcggcaaccagacggccctctgtggagggggcatccagacccgagaggtgtactgcgtgcaggccaacgaaaacctcctctcacaattaagtacccacaagaacaaagaagcctcaaagccaatggacttaaaattatgcactggacctatccctaatactacacagctgtgccacattccttgtccaactgaatgtgaagtttcaccttggtcagcttggggaccttgtacttatgaaaactgtaatgatcagcaagggaaaaaaggcttcaaactgaggaagcggcgcattaccaatgagcccactggaggctctggggtaaccggaaactgccctcacttactggaagccattccctgtgaagagcctgcctgttatgactggaaagcagtgagactgggaaactgcgagccagataacggaaaggagtgtggtccaggcacgcaagttcaagaggttgtgtgcatcaacagtgatggagaagaagttgacagacagctgtgcagagatgccatcttccccatccctgtggcctgtgatgccccatgcccgaaagactgtgtgctcagcacatggtctacgtggtcctcctgctcacacacctgctcagggaaaacgacagaagggaaacagatacgagcacgatccattctggcctatgcgggtgaagaaggtggaattcgctgtccaaatagcagtgctttgcaagaagtacgaagctgtaatgagcatccttgcacagtgtaccactggcaaactggtccctggggccagtgcattgaggacacctcagtatcgtccttcaacacaactacgacttggaatggggaggcctcctgctctgtcggcatgcagacaagaaaagtcatctgtgtgcgagtcaatgtgggccaagtgggacccaaaaaatgtcctgaaagccttcgacctgaaactgtaaggccttgtctgcttccttgtaagaaggactgtattgtgaccccatatagtgactggacatcatgcccctcttcgtgtaaagaaggggactccagtatcaggaagcagtctaggcatcgggtcatcattcagctgccagccaacgggggccgagactgcacagatcccctctatgaagagaaggcctgtgaggcacctcaagcgtgccaaagctacaggtggaagactcacaaatggcgcagatgccaattagtcccttggagcgtgcaacaagacagccctggagcacaggaaggctgtgggcctgggcgacaggcaagagccattacttgtcgcaagcaagatggaggacaggctggaatccatgagtgcctacagtatgcaggccctgtgccagcccttacccaggcctgccagatcccctgccaggatgactgtcaattgaccagctggtccaagttttcttcatgcaatggagactgtggtgcagttaggaccagaaagcgcactcttgttggaaaaagtaaaaagaaggaaaaatgtaaaaattcccatttgtatcccctgattgagactcagtattgtccttgtgacaaatataatgcacaacctgtggggaactggtcagactgtattttaccagagggaaaagtggaagtgttgctgggaatgaaagtacaaggagacatcaaggaatgcggacaaggatatcgttaccaagcaatggcatgctacgatcaaaatggcaggcttgtggaaacatctagatgtaacagccatggttacattgaggaggcctgcatcatcccctgcccctcagactgcaagctcagtgagtggtccaactggtcgcgctgcagcaagtcctgtgggagtggtgtgaaggttcgttctaaatggctgcgtgaaaaaccatataatggaggaaggccttgccccaaactggaccatgtcaaccagtttcaggtgtatgaggttgtcccatgccacagtgactgcaaccagtacctatgggtcacagagccctggagcatctgcaaggtgacctttgtgaatatgcgggagaactgtggagagggcgtgcaaacccgaaaagtgagatgcatgcagaatacagcagatggcccttctgaacatgtagaggattacctctgtgacccagaagagatgcccctgggctctagagtgtgcaaattaccatgccctgaggactgtgtgatatctgaatggggtccatggacccaatgtgttttgccttgcaatcaaagcagtttccggcaaaggtcagctgatcccatcagacaaccagctgatgaaggaagatcttgccctaatgctgttgagaaagaaccctgtaacctgaacaaaaactgctaccactatgattataatgtaacagactggagtacatgtcagctgagtgagaaggcagtttgtggaaatggaataaaaacaaggatgttggattgtgttcgaagtgatggcaagtcagttgacctgaaatattgtgaagcgcttggcttggagaagaactggcagatgaacacgtcctgcatggtggaatgccctgtgaactgtcagctttctgattggtctccttggtcagaatgttctcaaacatgtggcctcacaggaaaaatgatccgaagacgaacagtgacccagccctttcaaggtgatggaagaccatgcccttccctgatggaccagtccaaaccctgcccagtgaagccttgttatcggtggcaatatggccagtggtctccatgccaagtgcaggaggcccagtgtggagaagggaccagaacaaggaacatttcttgtgtagtaagtgatgggtcagctgatgatttcagcaaagtggtggatgaggaattctgtgctgacattgaactcattatagatggtaataaaaatatggttctggaggaatcctgcagccagccttgcccaggtgactgttatttgaaggactggtcttcctggagcctgtgtcagctgacctgtgtgaatggtgaggatctaggctttggtggaatacaggtcagatccagaccggtgattatacaagaactagagaatcagcatctgtgcccagagcagatgttagaaacaaaatcatgttatgatggacagtgctatgaatataaatggatggccagtgcttggaagggctcttcccgaacagtgtggtgtcaaaggtcagatggtataaatgtaacagggggctgcttggtgatgagccagcctgatgccgacaggtcttgtaacccaccgtgtagtcaaccccactcgtactgtagcgagacaaaaacatgccattgtgaagaagggtacactgaagtcatgtcttctaacagcacccttgagcaatgcacacttatccccgtggtggtattacccaccatggaggacaaaagaggagatgtgaaaaccagtcgggctgtacatccaacccaaccctccagtaacccagcaggacggggaaggacctggtttctacagccatttgggccagatgggagactaaagacctgggtttacggtgtagcagctggggcatttgtgttactcatctttattgtctccatgatttatctagcttgcaaaaagccaaagaaaccccaaagaaggcaaaacaaccgactgaaacctttaaccttagcctatgatggagatgccgacatgtaacatataacttttcctggcaacaaccagtttcggctttctgacttcatagatgtccagaggccacaacaaatgtatccaaactgtgtggattaaaatatattttaatttttaaaaatggcatcataaagacaagagtgaaaatcatactgccactggagatatttaagacagtaccacttatatacagaccatcaaccgtgagaattataggagatttagctgaatacatgctgcattctgaaagttttatgtcatcttttctgaaatctaccgactgaaaaaccactttcatctctaaaaaataatggtggaattggccagttaggatgcctgatacaagaccgtctgcagtgttaatccataaaacttcctagcatgaagagtttctaccaagatctccacaatactatggtcaaattaacatgtgtactcagttgaatgacacacattatgtcagattatgtacttgctaataagcaattttaacaatgcataacaaataaactctaagctaagcagaaaatccactgaataaattcagcatcttggtggtcgatggtagattttattgacctgcatttcagagacaaagcctcttttttaagacttcttgtctctctccaaagtaagaatgctggacaagtactagtgtcttagaagaacgagtcctcaagttcagtattttatagtggtaattgtctggaaaactaatttacttgtgttaatacaatacgtttctactttccctgattttcaaactggttgcctgcatcttttttgctatatggaaggcacatttttgcactatattagtgcagcacgataggcgcttaaccagtattgccatagaaactgcctcttttcatgtgggatgaagacatctgtgccaagagtggcatgaagacatttgcaagttcttgtatcctgaagagagtaaagttcagtttggatggcagcaagatgaaatcagctattacacctgctgtacacacacttcctcatcactgcagccattgtgaaattgacaacatggcggtaatttaagtgttgaagtccctaaccccttaaccctctaaaaggtggattcctctagttggtttgtaattgttctttgaaggctgtttatgactagatttttatatttgttatctttgttaagaaaaaaaaagaaaaaggaactggatgtctttttaattttgagcagatggagaaaataaataatgtatcaatgacctttgtaactaaaggaaatcaaaattatatgttgatttttctttctctctgatttcccagtttcagattgaatgtctgtcttgcaggcagttatttcaaaatccatagtcttttgcctttctcactggcaaaatttgaagcaatctctctcttcaatgtatgatttcaaaactaaaattttaaaagagaagaataaatatcttatccaagacttcattgcatatctagagcaagagtggcaaactttttctgtaaaggactatatagaaaatattttccacaaggtctatgttgcaacttctcaactttgccattctgctaatgcaatcttagtaaataaaagaatgaacataactgttttcctatataacttcccttacaaaaacagccagtaggccacctttgcaggtcatattttgctgacccctggtctggatgttttttaatgctagctctccatggtgtcatctttcgttttcattcatttttcaaaggtgagaatttacagtcattacatttcccactgtatcagaagtagctgtattttctacagatgtagccctgggaatggcacagtggaacaatatttaactaactcagcagacttcttgcaaatgaaaagaaaactcaaaaggtgccattaaaaagcaataccattttcaggcaacattattgcaacaacctttgtgagagaggacactagcttttcaggatatttgaaaaataatataactaacatgctattttatcttaaacagctgtgttcctgtaaaagtgttttggattagaaggtatttttaccttcatactggagtatgaactccccctgctgttcattagagtatttgcaaagattacaaaagacatcaggttaggatgtcattgtccccaaaatgaaaatatttgtatgtatttcaataagaactaaatgcagtaagcgctaattcctcattcaatattcactatattaggaaatgtaaatcatttcaaagagaacaggtagtcaggaagatgaaaattttactttaaagcaaggatttaaacaaagaaaaccataaaaacaaagtccattttatctgttttattaaagaggaagaaaaaataatattgttactttaaaactgtgattgtcaatatatataatcaggggtcttccagataatcctaaagttgatctctttgaataaaataaactccatttgtccaaaatagttaagaaagactctattgtggttacttgaaaaattcagctaaccctcttatgaaatgtgtgcaacacctattaattttgaaatgtgggatagaatacctactaaagctatatttaaggtattgtaaaatgtcattaattcagaaaagattagtatcatcctacctataagaattaaattagcaaatcaaaattatagaatgttatgaaaaatacattttattcataaattaattagattttacagcatatatgcatgcatatatatatatacacacacacacacacacacccatatatatgagagagaggaaattaggttcaacatgacctaatattagagaacatattggaaggtcactgtttgttaggataaataaatactggataacctcgttagaaaggtggaaagaggagaacgtagcaatctggctattttggacaaagggaaggttattatattcatgtttataacatgaaaatggccttatttttgtttctgacatgagacaataatgagttaaatattttattggaatttcatcaaaaccttatttttactgttccttctaaaaatttgggaggggaatatagtagtaacttctctattgacacttttacctcaccgagggggtaaaagatgtagaactgctgttccctagaatgaaggtctgttgtttggtttttaaaaaaagaagagcagaaaaagtttgacacagtattatatgattttgctggactatttcactagaaaccacgtagaataggactaactgatctcttttgaaaggggctgatttgcttattcatcaataactaatccaatatgtggacagtaatcttaatttcaaagccttttttgaggatactacggtgtagcttaagtgaatttaaaaagagtgcataaaagcttgtttttaattacttataacaaagcacaaattacttctaacaaggcaaatatttattgacatataagacattctgctaggcattgtaaaaaaaaaaaaaaaagtaatggcttttgtatacataggtacttaagacagacatccaaaagaaggaaaaaatgcttaatgagtgaagatagcactgaaacatgttgacttttactctaggtttgtttttagatggggttagtattttcccctacgtaatgtacatgtctttaggccacagtattaggagtttgatttttccctgccccaccctcaggtaggtggcagtggtcattgtagcttaatcagacccctgttaagttcctgggcatttcaaggtaaattcacgtcttccttctcacagaaattgaatagacctctcacacacttatttacctcccccaacaacctgtatccttggccctttctgattttctctgcttggtctctttctactcttgacagctattcttacctacttcccactaaacatgcccaattttttaattaaaaaaaaaagaattcctatatttccttccctattagaatcaaagtgtcactcactcagagtgtgaacatcctgatttacaccaaatccactggtcaaagaaatgaataaagggaaaaggaaaaatgtggaaggcatgcaggaaaaaaaaaaaaaaaaaagcccttttctgtaaaaatgtccatgcctacacttgctttagaccatcccatatcctcctgcctccatctcgagtctttgttcacattccacaccacaagacagtgagggaggactgtacttttcagtaccatacagaagggagagcctgttctaaagctgacgtgggtctcaatagtacatgagaagcacaattcccaaatgatctgggatctcctgtttataaatatattaccaaattcaagtgtgggttcttcttctatttccactgtaagattgagggtgttgaaaaaacagtagtccttgagcaaatctgtgaggaatcttgtcagaatgtgatctttcctgggactagtttagttgtgagaactacatctgcttgttctgggaataagggtctccccaggtcctgccctcaggtggccctggctgcaggacaggatttcaggtatcagaaactggtgtgtgagccaagcaaatagttatccatttataaaaaggatggtttgcagtgtgttataataattttatatctagcagggacaatgaaaaatggttatgtctacattattaaatgaatgaaactaatgctaaacagttaattttgcatttttatttttctgtgtttctaccaagtcagatcttaaaaatgggcagtatatgaagagctttagtttgtgggagtcatgttttcagtgatcaaaaatctctatattatttagaatataattgtcagtcttgttgtgttttgtagatttattgtttttaagccatagtttctagattacctacttttaaccctcaagtaaacttttccctatttttcagaaatctgtttgtgtttatttttagaaagtaaacatttagattccttttctggtactttttttctccatttctatcacacagatttgaagagatcagtatctatcattgtaaaatataactttattaaaatttgcaatctgtctttctataaattattattccctaaatgtgtattttatgttaatttaactacctgaatatttattttgtttaaataaggaggcagctgtctaagaatttttgttaatattactttgtaaattgcgtaatgtaatttattttacattatgtacatttcctttttaacgcacaaaatgtctatgtacaattaactacagatttgcaaataatgtcactaagctttattcagtcaatacagatggcatgtgaagatgtaatatgcttttttacattttcatatgggttatttgtaaataactatattgctgacaaacataaatacggaaatcattttcattct

SEQ ID NO: 31552 - DNA, 6477 bp, Homo sapiens
attctgcgaggaatggcagcggcagcagcatccccgccagaggcggcggcggcggcggcagcggccacggccaccaccgcggacgctattgttccctggtgttagacgcgctctccctccttctcatctgaagcgaacaatagcaggaaagagctttgctttctgtactctttgaaaagacgttccaagagcggagaaaaattccctgccgagcgtgctacggctctggaccctggagtggctgcaggcggcatggggctgcaagccaggcgctgggcgtccgggagccggggcgctgcggggccgcgccggggcgtcctgcagctgctgccgctgccgctgccgctgccgctgctcctgctgctgctgctacgcccgggcgccggcagggctgcggcgcagggcgaggcggaggcgcccaccctctatctgtggaagactggtccatggggccgatgtatgggagatgaatgtggtcccggaggcatccaaacgagggctgtgtggtgtgctcatgtggagggatggactacactgcatactaactgtaagcaggccgagagacccaataaccagcagaattgtttcaaagtttgcgattggcacaaagagttgtacgactggagactgggaccttggaatcagtgtcagcccgtgatttcaaaaagcctagagaaacctcttgagtgcattaagggggaagaaggtattcaggtgagggagatagcgtgcatccagaaagacaaagacattcctgcggaggatatcatctgtgagtactttgagcccaagcctctcctggagcaggcttgcctcattccttgccagcaagattgcatcgtgtctgaattttctgcctggtccgaatgctccaagacctgcggcagcgggctccagcaccggacgcgtcatgtggtggcgcccccgcagttcggaggctctggctgtccaaacctgacggagttccaggtgtgccaatccagtccatgcgaggccgaggagctcaggtacagcctgcatgtggggccctggagcacctgctcaatgccccactcccgacaagtaagacaagcaaggagacgcgggaagaataaagaacgggaaaaggaccgcagcaaaggagtaaaggatccagaagcccgcgagcttattaagaaaaagagaaacagaaacaggcagaacagacaagagaacaaatattgggacatccagattggatatcagaccagagaggttatgtgcattaacaagacggggaaagctgctgatttaagcttttgccagcaagagaagcttccaatgaccttccagtcctgtgtgatcaccaaagagtgccaggtttccgagtggtcagagtggagcccctgctcaaaaacatgccatgacatggtgtcccctgcaggcactcgtgtaaggacacgaaccatcaggcagtttcccattggcagtgaaaaggagtgtccagaatttgaagaaaaagaaccctgtttgtctcaaggagatggagttgtcccctgtgccacgtatggctggagaactacagagtggactgagtgccgtgtggaccctttgctcagtcagcaggacaagaggcgcggcaaccagacggccctctgtggagggggcatccagacccgagaggtgtactgcgtgcaggccaacgaaaacctcctctcacaattaagtacccacaagaacaaagaagcctcaaagccaatggacttaaaattatgcactggacctatccctaatactacacagctgtgccacattccttgtccaactgaatgtgaagtttcaccttggtcagcttggggaccttgtacttatgaaaactgtaatgatcagcaagggaaaaaaggcttcaaactgaggaagcggcgcattaccaatgagcccactggaggctctggggtaaccggaaactgccctcacttactggaagccattccctgtgaagagcctgcctgttatgactggaaagcagtgagactgggaaactgcgagccagataacggaaaggagtgtggtccaggcacgcaagttcaagaggttgtgtgcatcaacagtgatggagaagaagttgacagacagctgtgcagagatgccatcttccccatccctgtggcctgtgatgccccatgcccgaaagactgtgtgctcagcacatggtctacgtggtcctcctgctcacacacctgctcagggaaaacgacagaagggaaacagatacgagcacgatccattctggcctatgcgggtgaagaaggtggaattcgctgtccaaatagcagtgctttgcaagaagtacgaagctgtaatgagcatccttgcacagtgtaccactggcaaactggtccctggggccagtgcattgaggacacctcagtatcgtccttcaacacaactacgacttggaatggggaggcctcctgctctgtcggcatgcagacaagaaaagtcatctgtgtgcgagtcaatgtgggccaagtgggacccaaaaaatgtcctgaaagccttcgacctgaaactgtaaggccttgtctgcttccttgtaagaaggactgtattgtgaccccatatagtgactggacatcatgcccctcttcgtgtaaagaaggggactccagtatcaggaagcagtctaggcatcgggtcatcattcagctgccagccaacgggggccgagactgcacagatcccctctatgaagagaaggcctgtgaggcacctcaagcgtgccaaagctacaggtggaagactcacaaatggcgcagatgccaattagtcccttggagcgtgcaacaagacagccctggagcacaggaaggctgtgggcctgggcgacaggcaagagccattacttgtcgcaagcaagatggaggacaggctggaatccatgagtgcctacagtatgcaggccctgtgccagcccttacccaggcctgccagatcccctgccaggatgactgtcaattgaccagctggtccaagttttcttcatgcaatggagactgtggtgcagttaggaccagaaagcgcactcttgttggaaaaagtaaaaagaaggaaaaatgtaaaaattcccatttgtatcccctgattgagactcagtattgtccttgtgacaaatataatgcacaacctgtggggaactggtcagactgtattttaccagagggaaaagtggaagtgttgctgggaatgaaagtacaaggagacatcaaggaatgcggacaaggatatcgttaccaagcaatggcatgctacgatcaaaatggcaggcttgtggaaacatctagatgtaacagccatggttacattgaggaggcctgcatcatcccctgcccctcagactgcaagctcagtgagtggtccaactggtcgcgctgcagcaagtcctgtgggagtggtgtgaaggttcgttctaaatggctgcgtgaaaaaccatataatggaggaaggccttgccccaaactggaccatgtcaaccaggcacaggtgtatgaggttgtcccatgccacagtgactgcaaccagtacctatgggtcacagagccctggagcatctgcaaggtgacctttgtgaatatgcgggagaactgtggagagggcgtgcaaacccgaaaagtgagatgcatgcagaatacagcagatggcccttctgaacatgtagaggattacctctgtgacccagaagagatgcccctgggctctagagtgtgcaaattaccatgccctgaggactgtgtgatatctgaatggggtccatggacccaatgtgttttgccttgcaatcaaagcagtttccggcaaaggtcagctgatcccatcagacaaccagctgatgaaggaagatcttgccctaatgctgttgagaaagaaccctgtaacctgaacaaaaactgctaccactatgattataatgtaacagactggagtacatgtcagctgagtgagaaggcagtttgtggaaatggaataaaaacaaggatgttggattgtgttcgaagtgatggcaagtcagttgacctgaaatattgtgaagcgcttggcttggagaagaactggcagatgaacacgtcctgcatggtggaatgccctgtgaactgtcagctttctgattggtctccttggtcagaatgttctcaaacatgtggcctcacaggaaaaatgatccgaagacgaacagtgacccagccctttcaaggtgatggaagaccatgcccttccctgatggaccagtccaaaccctgcccagtgaagccttgttatcggtggcaatatggccagtggtctccatgccaagtgcaggaggcccagtgtggagaagggaccagaacaaggaacatttcttgtgtagtaagtgatgggtcagctgatgatttcagcaaagtggtggatgaggaattctgtgctgacattgaactcattatagatggtaataaaaatatggttctggaggaatcctgcagccagccttgcccaggtgactgttatttgaaggactggtcttcctggagcctgtgtcagctgacctgtgtgaatggtgaggatctaggctttggtggaatacaggtcagatccagaccggtgattatacaagaactagagaatcagcatctgtgcccagagcagatgttagaaacaaaatcatgttatgatggacagtgctatgaatataaatggatggccagtgcttggaagggctcttcccgaacagtgtggtgtcaaaggtcagatggtataaatgtaacagggggctgcttggtgatgagccagcctgatgccgacaggtcttgtaacccaccgtgtagtcaaccccactcgtactgtagcgagacaaaaacatgccattgtgaagaagggtacactgaagtcatgtcttctaacagcacccttgagcaatgcacacttatccccgtggtggtattacccaccatggaggacaaaagaggagatgtgaaaaccagtcgggctgtacatccaacccaaccctccagtaacccagcaggacggggaaggacctggtttctacagccatttgggccagatgggagactaaagacctgggtttacggtgtagcagctggggcatttgtgttactcatctttattgtctccatgatttatctagcttgcaaaaagccaaagaaaccccaaagaaggcaaaacaaccgactgaaacctttaaccttagcctatgatggagatgccgacatgtaacatataacttttcctggcaacaaccagtttcggctttctgacttcatagatgtccagaggccacaacaaatgtatccaaactgtgtggattaaaatatattttaatttttaaaaatggcatcataaagacaagagtgaaaatcatactgccactggagatatttaagacagtaccacttatatacagaccatcaaccgtgagaattataggagatttagctgaatacatgctgcattctgaaagttttatgtcatcttttctgaaatctaccgactgaaaaaccactttcatctctaaaaaataatggtggaattggccagttaggatgcctgatacaagaccgtctgcagtgttaatccataaaacttcctagcatgaagagtttctaccaagatctccacaatactatggtcaaattaacatgtgtactcagttgaatgacacacattatgtcagattatgtacttgctaataagcaattttaacaatgcataacaaataaactctaagctaagcagaaaatccactgaataaattcagcatcttggtggtcgatggtagattttattgacctgcatttcagagacaaagcctcttttttaagacttcttgtctctctccaaagtaagaatgctggacaagtactagtgtcttagaagaacgagtcctcaagttcagtattttatagtggtaattgtctggaaaactaatttacttgtgttaatacaatacgtttctactttccctgattttcaaactggttgcctgcatcttttttgctatatggaaggcacatttttgcactatattagtgcagcacgataggcgcttaaccagtattgccatagaaactgcctcttttcatgtgggatgaagacatctgtgccaagagtggcatgaagacatttgcaagttcttgtatcctgaagagagtaaagttcagtttggatggcagcaagatgaaatcagctattacacctgctgtacacacacttcctcatcactgcagccattgtgaaattgacaacatggcggtaatttaagtgttgaagtccctaaccccttaaccctctaaaaggtggattcctctagttggtttgtaattgttctttgaaggctgtttatgactagatttttatatttgttatctttgttaagaaaaaaaaagaaaaaggaactggatgtctttttaattttgagcagatggagaaaataaataatgtatcaatgacctttgtaactaaaggaaa

SEQ ID NO: 31553 - DNA, 3967 bp, Homo sapiens
tgaggagcagccacttccctgcaggctgagcggagccctggatggagcttggcacccaagcccctcatgtctgccctgctgagtctgtgttttgtgctgcccctggcggcccccggccacggcacgcagggttgggagccctgcacagacctgcgccccctggacatcctggcggaagtggtcccttctgatggcgccacaagcgggatcaggatagttcaggttcacggtgcacggggactccagctctcagtagccgccccccgcaccatgagcttcccagcatccaggattttctcccagtgtgacctcttccctgaagaattttccatcgtcgtaactttgagagttcccaatcttccacccaagaggaacgagtacctgctgacggtggtggcagaggagagcgacctgctgctgctcggcctgcggttgtcacctgcccagctgcacttcctgttccttcgcgaggacacggccggcgcctggcagacccgagtgtccttccgcagcccggccctggtggatggccgctggcacacactggtcctggctgtgtccgcaggcgtcttctccctcaccacggactgcggcctcccggtggacataatggccgatgtgcccttcccagccaccctgtcagtgaaaggagctcgattcttcgtcggcagccggaggagagccaaaggcctgttcatgggactggtgaggcaactggtcctgctgccgggctcagacgccaccccaaggctgtgtcccagcaggaacgccccgctggcggtgctgtccatcccacgggtcctgcaggctctcacggggaagccagaagataacgaggtgctaaaatatccctatgaaaccaacattcgagtgacgctgggaccccagccaccgtgtaccgaggtggaagacgcccagttctggtttgatgccagccggaagggcctgtatctgtgtgttggcaacgagtgggtctccgtgttagcagccaaagaaagactggactacgtggaggagcatcagaacttgtccaccaactcagagaccctgggcattgaggtgttccgcatccctcaggtggggctctttgtggccacagccaatcgcaaagccacatccgccgtctacaagtggaccgaagagaagttcgtctcatatcagaacatccccacgcaccaagcacaggcctggaggcatttcaccatcgggaaaaagatcttcctggcagtggctaattttgaaccagatgagaagggtcaggagttctctgtcatttacaaatggagccacagaaagctgaagtttaccccatatcagagcattgccacacacagcgcccgagactgggaggccttcgaggtggatggggagcacttcctggcggtggccaaccaccgggaaggcgacaaccacaacatcgacagtgtcatctacaagtggaacccggcaacccggctcttcgaggccaaccagaccatcgccacctccggcgcctacgactgggagttcttcagtgtggggccctactcgttcctggtggtggccaacaccttcaacggcacctccaccaaggtgcactcgcacctctacatccgactcctgggctccttccagctcttccagtccttcccgacgttcggtgctgcagactgggaggtcttccagatcggggagaggatcttcctcgctgtggcaaacagtcacagctacgatgtggagatgcaagtccagaatgattcctatgtcatcaactccgtcatctacgagctgaacgtgaccgcgcaggcctttgtcaagttccaggacattctcacctgcagtgctctggactgggagtttttctcggtgggagaagattatttcctggtggtggccaactccttcgatgggcgtaccttctcggtgaacagtattatttacaggtggcagggctacgagggcttcgtggcggtgcacagcctccccaccgtcggctgcagggactgggaggccttcagcaccacggctggtgcctacctcatctactccagcgccaaggagcccctctccagggtcctgcggctgaggacacgctgaggccgcggctgcccggcagcaactggggtggccaggtggggcgggaccccagcacctcccccaactgaccctggacgtccaggtgggcccagcctagggcatcccgggcctgggcatcaggcagggtgcaggtggggccatctgcggccctggttcgggcagggacatccatccacctctgagtccttctgagccacagccccagtgacggtctggtcttgcaggcagaggcccagagcccctgccagtgctcgcccatctgagtgtcaagcggggatttcgctgtcaaggaaccgtttctatacatttttacctcaaacaacaggacctcggttcatgtccctgcggctggcctctcgccagccactcctgcagtgtgcgtccggccgcctgagcaggtgtggtgccgtcccgccattgccgccacctatttattgtgttttatctgaacggaagtgtatttatactgctctttacaaaagcaccggtgctcctctctaggcagcgggtgggcacagcccctcaccacggacacggacagaggaccacctccccatacagagagaggcttccctcccagcctcagtttacccgtaaatgcactagcgcgaggtcagaaatcacaagcctgggcatggcctgggtcgcaccccctccccacggccccacccacagggacctcaacttctgggcccgggattttttccctattcagcagcattttaatcacatgtcctccagctgactgggactcaggctgcgtgcctccgtctgcctgtgtgctggctgtcctagctccctggtaacagcatcctctgctggctctcctgtggtcatcttgtctctgcagctgggagagctgcttgtctgtccgtcacaggcagtgaggatgagagggggtgatgggcgcaaggccccaggggtcctccctcttaacccatgtaggtgccagagaaaccacccccactccatgagaagaggctcagacagcaggctccggggccacgcagcccagaccacacctgccacggtcttccaggaacggtgctcctgcttctgcaacacaaatcggaacaggagcgatcctcagagagtttacaatgtgctttttccgccaatcagaactgtggacaaaacttcctatttcctacaccgcagctgtctgttcaccttcagctcagagagcactcctgacctttcgtaatgaaatggaagcctccccttgtctggcaaataataaactcagtgtctacttttgccggctttgggaccttcgtgtttttccggggctcaggtctcactccagccatcgctgtggccagtggagagccactcccctctgggggcagtcgccgagagcctccttcccctccgtccagccagcaaggctttcccaagcgtcctgggcaggagggttgggccctgctttccaccaagtcactcagaaggtcccaatcacacatgattggcctcattgggtcagcacctgtgaaaggaagattaaaaactcgacaccccaattcactcaaccaagaagaaaaaagctgaaagctgagtcctgcaggaagctgcctttccctttgccctaagcagacagctgcagatgagagggtcagcatctccactagtggctgctctgtgtgccccttatctcatggaaagtgccaatttactgagcacgagataaacaggtaactgactgttcccacctgctccttttctcctgcagcatggagcaatcagtcatgtgaccacaccctcctccctctgccccctccagccggcttttccccttgactgaagccttcaacatcatcttgggagagaggcacagacctgtctcctgggtgcatccttagccttggcaaaataaacttctccattgatcgag

SEQ ID NO: 31554 - DNA, 1866 bp, Homo sapiens
tgaggagcagccacttccctgcaggctgagcggagccctggatggagcttggcacccaagcccctcatgtctgccctgctgagtctgtgttttgtgctgcccctggcggcccccggccacggcacgcagggttgggagccctgcacagacctgcgccccctggacatcctggcggaagtggtcccttctgatggcgccacaagcgggatcaggatagttcaggttcacggtgcacggggactccagctctcagtagccgccccccgcaccatgagcttcccagcatccaggattttctcccagtgtgacctcttccctgaagaattttccatcgtcgtaactttgagagttcccaatcttccacccaagaggaacgagtacctgctgacggtggtggcagaggagagcgacctgctgctgctcggcctgcggttgtcacctgcccagctgcacttcctgttccttcgcgaggacacggccggcgcctggcagacccgagtgtccttccgcagcccggccctggtggatggccgctggcacacactggtcctggctgtgtccgcaggcgtcttctccctcaccacggactgcggcctcccggtggacataatggccgatgtgcccttcccagccaccctgtcagtgaaaggagctcgattcttcgtcggcagccggaggagagccaaaggcctgttcatgggactggtgaggcaactggtcctgctgccgggctcagacgccaccccaaggctgtgtcccagcaggaacgccccgctggcggtgctgtccatcccacgggtcctgcaggctctcacggggaagccagaagataacgaggtgctaaaatatccctatgaaaccaacattcgagtgacgctgggaccccagccaccgtgtaccgaggtggaagacgcccagttctggtttgatgccagccggaagggcctgtatctgtgtgttggcaacgagtgggtctccgtgttagcagaagccaaagaaagactggactacgtggaggagcatcagaacttgtccaccaactcagagaccctgggcattgaggtgttccgcatccctcaggtggggctctttgtggccacagccaatcgcaaagccacatccgccgtctacaagtggaccgaagagaagttcgtctcatatcagaacatccccacgcaccaagcacaggcctggaggcatttcaccatcgggaaaaagatcttcctggcagtggctaattttgaaccagatgagaagggtcaggagttctctgtcatttacaaatggagccacagaaagctgaagtttaccccatatcagagcattgccacacacagcgcccgagactgggaggccttcgaggtggatggggagcacttcctggcggtggccaaccaccgggaaggcgacaaccacaacatcgacagtgtcatctacaagtggaacccggcaacccggctcttcgaggccaaccagaccatcgccacctccggcgcctacgactgggagttcttcagtgtggggccctactcgttcctggtggtggccaacaccttcaacggcacctccaccaaggtgcactcgcacctctacatccgactcctgggctccttccagctcttccagtccttcccgacgttcggtgctgcagactgggaggtcttccagatcggggagaggatcttcctcgctgtggcaaacagtcacagctacgatgtggagatgcaagtccagaatgattcctatgtcatcaactccgtcatctacgagctgaacgtgaccgcgcaggcctttgtcaagttccaggacattctcacctgcagtggaggcaggagggggcttcatgcccgtcgtgcggagggatag

SEQ ID NO: 31555 - DNA, 2287 bp, Homo sapiens
agccctggatggagcttggcacccaagcccctcatgtctgccctgctgagtctgtgttttgtgctgcccctggcggcccccggccacggcacgcagggttgggagccctgcacagacctgcgccccctggacatcctggcggaagtggtcccttctgatggcgccacaagcgggatcaggatagttcaggttcacggtgcacggggactccagctctcagtagccgccccccgcaccatgagcttcccagcatccaggattttctcccagtgtgacctcttccctgaagaattttccatcgtcgtaactttgagagttcccaatcttccacccaagaggaacgagtacctgctgacggtggtggcagaggagagcgacctgctgctgctcggcctgcggttgtcacctgcccagccaccgtgtaccgaggtggaagacgcccagttctggtttgatgccagccggaagggcctgtatctgtgtgttggcaacgagtgggtctccgtgttagcagccaaagaaagactggactacgtggaggagcatcagaacttgtccaccaactcagagaccctgggcattgaggtgttccgcatccctcaggtggggctctttgtggccacagccaatcgcaaagccacatccgccgtctacaagtggaccgaagagaagttcgtctcatatcagaacatccccacgcaccaagcacaggcctggaggcatttcaccatcgggaaaaagatcttcctggcagtggctaattttgaaccagatgagaagggtcaggagttctctgtcatttacaaatggagccacagaaagctgaagtttaccccatatcagagcattgccacacacagcgcccgagactgggaggccttcgaggtggatggggagcacttcctggcggtggccaaccaccgggaaggcgacaaccacaacatcgacagtgtcatctacaagtggaacccggcaacccggctcttcgaggccaaccagaccatcgccacctccggcgcctacgactgggagttcttcagtgtggggccctactcgttcctggtggtggccaacaccttcaacggcacctccaccaaggtgcactcgcacctctacatccgactcctgggctccttccagctcttccagtccttcccgacgttcggtgctgcagactgggaggtcttccagatcggggagaggatcttcctcgctgtggcaaacagtcacagctacgatgtggagatgcaagtccagaatgattcctatgtcatcaactccgtcatctacgagctgaacgtgaccgcgcaggcctttgtcaagttccaggacattctcacctgcagtgctctggactgggagtttttctcggtgggagaagattatttcctggtggtggccaactccttcgatgggcgtaccttctcggtgaacagtattatttacaggtggcagggctacgagggcttcgtggcggtgcacagcctccccaccgtcggctgcagggactgggaggccttcagcaccacggctggtgcctacctcatctactccagcgccaaggagcccctctccagggtcctgcggctgaggacacgctgaggccgcggctgcccggcagcaactggggtggccaggtggggcgggaccccagcacctcccccaactgaccctggacgtccaggtgggcccagcctagggcatcccgggcctgggcatcaggcagggtgcaggtggggccatctgcggccctggttcgggcagggacatccatccacctctgagtccttctgagccacagccccagtgacggtctggtcttgcaggcagaggcccagagcccctgccagtgctcgcccatctgagtgtcaagcggggatttcgctgtcaaggaaccgtttctatacatttttacctcaaacaacaggacctcggttcatgtccctgcggctggcctctcgccagccactcctgcagtgtgcgtccggccgcctgagcaggtgtggtgccgtcccgccattgccgccacctatttattgtgttttatctgaacggaagtgtatttatactgctctttacaaaagcaccggtgctcctctctaggcagcgggtgggcacagcccctcaccacggacacggacagaggaccacctccccatacagagagaggcttccctcccagcctcagtttacccgtaaatgcactagcgcgaggtcagaaatcacaagcctgggcatggcctgggtcgcaccccctccccacggccccacccacagggacctcaac

SEQ ID NO: 31556 - DNA, 2367 bp, Homo sapiens
gagggccggcctggacccggcgggcgcacggctccgagcccagcgcagccgagccggtctgcagaggggcccccagaactttgtgtgtgtgtgtgcacgcgcgcgcgtgtgtgcccaggtgcgagggttcgcgcgtgtgctggcggggagggaaccgacccgaaagagagccccacgctggcaaagtggctcgcccatctcacagccggttggcgctcgcggaggctcacagaacatttcctgcctgttgctcacactctgttgtccacagcatacccgcaccctagatggctgactcttgtcttctgtctctttattttccatgtgtgagcctgtgcctgtggtttatctctggaggatgtgcctgagggaggagacatatactgcctggactgcctggctgatgtgagctagtttgtctggttgagttggatgtttaaatagaaggcagaacaacaacagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaacttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaatggggtttgaaccagtgctctctctaaatg

SEQ ID NO: 31557 - DNA, 2185 bp, Homo sapiens
aaccgacccgaaagagagccccacgctggcaaagtggctcgcccatctcacagccggttggcgctcgcggaggctcacagaacatttcctgcctgttgctcacactctgttgtccacagcatacccgcaccctagatggctgactcttgtcttctgtctctttattttccatgtgtgagcctgtgcctgtggtttatctctggaggatgtgcctgagggaggagacatatactgcctggactgcctggctgatgtgagctagtttgtctggttgagttggatgtttaaatagaaggcagaacaacaacagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaacttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaa

SEQ ID NO: 31558 - DNA, 1792 bp, Homo sapiens
actccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaacttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaatggggtttgaaccagtgctctctctaaatgaa

SEQ ID NO: 31559 - DNA, 1901 bp, Homo sapiens
aaggaataaagttgctgattcattcctttacactgaaaccctttgttgtgccctcctcttccttcctctttatagggagacactctgagaaagagcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaacttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaatggggtttgaaccagtgctctctctaaatg

SEQ ID NO: 31560 - DNA, 2202 bp, Homo sapiens
aaggaataaagttgctgattcattcctttacactgaaaccctttgttgtgccctcctcttccttcctctttatagggagacactctgagaaagagcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagcttggccttttaatcatgcaagagagaataaaaggtcacatgggtggccagcaggctccacaaagaattccacccacccgtttgtcgaagccgagtggtatctatgtgaatctccattatgccactctacctttctgtatggttcccctcatcagccaagcctgcgaacttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaatggggtttgaaccagtgctctctctaaatg

SEQ ID NO: 31561 - DNA, 2064 bp, Homo sapiens
aaggaataaagttgctgattcattcctttacactgaaaccctttgttgtgccctcctcttccttcctctttatagggagacactctgagaaagagcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaacttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaatggggtttgaaccagtgctctctctaaatg

SEQ ID NO: 31562 - DNA, 752 bp, Homo sapiens
gtgtgcacgcgcgcgcgtgtgtgcccaggtgcgagggttcgcgcgtgtgctggcggggagggaaccgacccgaaagagagccccacgctggcaaagtggctcgcccatctcacagccggttggcgctcgcggaggagacatatactgcctggactgcctggctgatgtgagctagtttgtctggttgagttggatgtttaaatagaaggcagaacaacaacagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgag

SEQ ID NO: 31563 - DNA, 1963 bp, Homo sapiens
atagggagacactctgagaaagagcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaacttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaa

SEQ ID NO: 31564 - DNA, 1378 bp, Homo sapiens
gagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatgccccagagcatcatgcccaactccagacatcacgtggcctctagagggatgtggcctggagggaggcggctggcctgctacctccatcccttcaggatggccgaaggaattgcagaagtttaactgcttctctgctgcctctagattctctttcccaaacactgcattgctatctcctcgctcaaagtcccctggaagccgtctgtcaagaaactgattctgattattaaatgcagctgtagcttgttgctccatcagcctcagcaaggagtgctgattaaagaagttggagaagccaataagtcaaagtgcacggaccaccaagccacatcctggcaagcagtaaaggtactcccaggagcctgtcatagcacttgagactgtctgagcccctaagccatgagacggcacttgccaactggtgtctccatatttcctcccatgataccaggacatgtgaccctgagagctgacctagaagaggtcaatgatttggcctgctaggggcagacatactcaatgcacatgtccaagcaaggaggacacaataatattgccctcagctttgatcaatttatcctccaagccatttgtctgccgtttctaatttctttcaccatcccctcacccacccctccacgcagactaggtccagtgccccaaactccagagtagagttccaattttcgtcctcttccactcagcacaggattaagccttcaggactaagttcaagttccctagacgatatttaagggcccttgtgtcttagatccattgtgtgtgctccaccctgtctctcactgctccccaatacaaatcgtcactccagcctctccctgctcaccctcacctgctctggagagacctgacctctgccttgctcacgctgacactgcctcagaattgaaggcagtgtaacagtggggctcatattgattatgacgtgagcttgagcacatatc

SEQ ID NO: 31565 - DNA, 2080 bp, Homo sapiens
gagggccggcctggacccggcgggcgcacggctccgagcccagcgcagccgagccggtctgcagaggggcccccagaactttgtgtgtgtgtgtgcacgcgcgcgcgtgtgtgcccaggtgcgagggttcgcgcgtgtgctggcggggagggaaccgacccgaaagagagccccacgctggcaaagtggctcgcccatctcacagccggttggcgctcgcggagctctttattttccatgtgtgagcctgtgcctgtggtttatctctggaggatgtgcctgagggaggagacatatactgcctggactgcctggctgatgtgagctagtttgtctggttgagttggatgtttaaatagaaggcagaacaacaacaggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaacttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattg

SEQ ID NO: 31566 - DNA, 2601 bp, Homo sapiens
cccacccgtcccagctcggcttagcccccgcggacccctccaggccgcgaccccagggcgtcctgtgccgccacgccctccatctgtgtgggtcctctgctgggcccgcccctggtcacagccagactgactcagtttccctgggaggtcccgctcgagcccgtccttcccctccctctgcccgcccccagccctcgccccaccctcggcgcccgcacatctgcctgctcagctccagacggcgcccggacccccgggcgcgggatccagccaggtgggagccccgcagatgaggtctctgaaggtgtgcctgaaccagtgccagcctgccctgtctgcagcatcggcctgatggggtggtgactgatccctcagggctccggagccatgtggcccaacggcagttccctggggccctgtttccggcccacaaacattaccctggaggagagacggctgatcgcctcgccctggttcgccgcctccttctgcgtggtgggcctggcctccaacctgctggccctgagcgtgctggcgggcgcgcggcaggggggttcgcacacgcgctcctccttcctcaccttcctctgcggcctcgtcctcaccgacttcctggggctgctggtgaccggtaccatcgtggtgtcccagcacgccgcgctcttcgagtggcacgccgtggaccctggctgccgtctctgtcgcttcatgggcgtcgtcatgatcttcttcggcctgtccccgctgctgctgggggccgccatggcctcagagcgctacctgggtatcacccggcccttctcgcgcccggcggtcgcctcgcagcgccgcgcctgggccaccgtggggctggtgtgggcggccgcgctggcgctgggcctgctgcccctgctgggcgtgggtcgctacaccgtgcaatacccggggtcctggtgcttcctgacgctgggcgccgagtccggggacgtggccttcgggctgctcttctccatgctgggcggcctctcggtcgggctgtccttcctgctgaacacggtcagcgtggccaccctgtgccacgtctaccacgggcaggaggcggcccagcagcgtccccgggactccgaggtggagatgatggctcagctcctggggatcatggtggtggccagcgtgtgttggctgccccttctggtcttcatcgcccagacagtgctgcgaaacccgcctgccatgagccccgccgggcagctgtcccgcaccacggagaaggagctgctcatctacttgcgcgtggccacctggaaccagatcctggacccctgggtgtatatcctgttccgccgcgccgtgctccggcgtctccagcctcgcctcagcacccggcccaggtcgctgtccctccagccccagctcacgcagcgctccgggctgcagtaggaagtggacagagcgcccctcccgcgcctttccgcggagcccttggcccctcggacagcccatctgcctgttctgaggattcaggggctgggggtgctggatggacagtgggcatcagcagcagggttttgggttgaccccaatccaacccggggacccccaactcctccctgatccttttaccaagcactctcccttcctcggcccctttttcccatccagagctcccaccccttctctgcgtccctcccaaccccaggaagggcatgcagacattggaagagggtcttgcattgctatttttttttttagacggagtcttgctctgtcccccaggctggagtgcagtggcgcaatctcagctcactgcaacctccacctcccgggttcaagcgattctcctgcctcagcctcctgagtagctgggactataggcgcgcgccaccacgcccggctaatttttgtatttttagtagagacggggtttcaccgtgttggccaggctggtcttgaactcctgacctcaggtgattcaccagcctcagcctcccaaagtgctgggatcacaggcatgaaccaccacacctggccatttttttttttttttttagacggagtctcactctgtggcccagcctggagtacagtggcacgatctcggctcactgcaacctccgcctcccgggttcaagcgattctcgtgcctcagcctcccgagcagctgggattacaggcgtaagccactgcgcccggccttgcatgctctttgaccctgaatttgacctacttgctggggtacagttgcttccttttgaacctccaacagggaaggctctgtccagaaaggattgaatgtgaacgggggcacccccttttcttgccaaaatatatctctgcctttggttttattttcctttgggtccagaagttttcaatctctggagtttgtgcattgggcctcacccggagcagacgagggcagggctgggaaggatggggagggacatagaggattcggttcctcccccaccttgtttcttgagtgtttcctaatcacttgatgggtggtaccacctagaattcttccagcagcctgtaatgggagggctacaggttagccctggaacctgcaatcaaaccacctttgaatctgtgtgtcattaaaagtagatataaatgggc

SEQ ID NO: 31567 - DNA, 1941 bp, Homo sapiens
cccacccgtcccagctcggcttagcccccgcggacccctccaggccgcgaccccagggcgtcctgtgccgccacgccctccatctgtgtgggtcctctgctgggcccgcccctggtcacagccagactgactcagtttccctgggaggtcccgctcgagcccgtccttcccctccctctgcccgcccccagccctcgccccaccctcggcgcccgcacatctgcctgctcagctccagacggcgcccggacccccgggcgcgggatccagccaggtgggagccccgcagatgaggtctctgaaggtgtgcctgaaccagtgccagcctgccctgtctgcagcatcggcctgatggggtggtgactgatccctcagggctccggagccatgtggcccaacggcagttccctggggccctgtttccggcccacaaacattaccctggaggagagacggctgatcgcctcgccctggttcgccgcctccttctgcgtggtgggcctggcctccaacctgctggccctgagcgtgctggcgggcgcgcggcaggggggttcgcacacgcgctcctccttcctcaccttcctctgcggcctcgtcctcaccgacttcctggggctgctggtgaccggtaccatcgtggtgtcccagcacgccgcgctcttcgagtggcacgccgtggaccctggctgccgtctctgtcgcttcatgggcgtcgtcatgatcttcttcggcctgtccccgctgctgctgggggccgccatggcctcagagcgctacctgggtatcacccggcccttctcgcgcccggcggtcgcctcgcagcgccgcgcctgggccaccgtggggctggtgtgggcggccgcgctggcgctgggcctgctgcccctgctgggcgtgggtcgctacaccgtgcaatacccggggtcctggtgcttcctgacgctgggcgccgagtccggggacgtggccttcgggctgctcttctccatgctgggcggcctctcggtcgggctgtccttcctgctgaacacggtcagcgtggccaccctgtgccacgtctaccacgggcaggaggcggcccagcagcgtccccgggactccgaggtggagatgatggctcagctcctggggatcatggtggtggccagcgtgtgttggctgccccttctggtcttcatcgcccagacagtgctgcgaaacccgcctgccatgagccccgccgggcagctgtcccgcaccacggagaaggagctgctcatctacttgcgcgtggccacctggaaccagatcctggacccctgggtgtatatcctgttccgccgcgccgtgctccggcgtctccagcctcgcctcagcacccggcccagacggagtctcactctgtggcccagcctggagtacagtggcacgatctcggctcactgcaacctccgcctcccgggttcaagcgattctcgtgcctcagcctcccgagcagctgggattacaggcgtaagccactgcgcccggccttgcatgctctttgaccctgaatttgacctacttgctggggtacagttgcttccttttgaacctccaacagggaaggctctgtccagaaaggattgaatgtgaacgggggcacccccttttcttgccaaaatatatctctgcctttggttttattttcctttgggtccagaagttttcaatctctggagtttgtgcattgggcctcacccggagcagacgagggcagggctgggaaggatggggagggacatagaggattcggttcctcccccaccttgtttcttgagtgtttcctaatcacttgatgggtggtaccacctagaattcttccagcagcctgtaatgggagggctacaggttagccctggaacctgcaatcaaaccacctttgaatctgtgtgtcattaaaagtagatataaatgggc

SEQ ID NO: 31568 - DNA, 1422 bp, Homo sapiens
atgcgagaggtgcgggcgcggctggcggccacgcaggttgaatatatttcaggaaaggtttttttcaccacctgttctgatttgaatatgttgaagaaattaaaatctgcagaaagattatttttgctgattaaaaagcagtttccacttattatttcttctgtaagtaaaggaaaaatatttaatgaaatgcaaagacttataaatgaagatccaggaagttggttgaatgccatttcaatttggaaaaatcttcttgaacttgatgcaaaaaaggaaaaactttctcagagagatgataaccaactaaaaagaaaagtgggagaaaatgaaatcattgcaaagaaattaaaaatagaacaaatgcaaaagatagaagagaatagggactgccagctggaaaaacaaataaaagaagaaactctggagcaaagagattttaccactaaaagcgaaaagtttcaagaagaagaatttcagaatgacatagagaaagcaattgatactcataatcagaatgacttgactttcagagtatcttgtcgctgcagtggaactattggaaaggccttcactgcacaggaggtaggaaaagtaattggaattgctattatgaaacactttggatggaaagcagacttgaggaatccacaattagagatctttatacatctaaatgacatttactctgtggtggggattcctgtgttcagggtttccctagccagcagagcttacatcaagacagctggactgcgatctacaatagcgtgggcaatggcatctctggctgacattaaggctggtgcatttgttttagatccaatgtgtggacttggaacaatacttttggaagctgctaaagaatggccagatgtgtattatgtaggtgctgatgtcagcgactcacagttactaggtacttgggacaatctgaaagctgcaggccttgaggataaaattgaattacttaaaatctctgttatagaattgccattgccttcagaaagtgttgatattattatttctgacattccatttgggaaaaagtttaagttaggaaaagacatcaaaagcattctacaagaaatggaaagagtgcttcatgttggcggaaccattgtattgttgcttagtgaagatcaccacaggcgccttacagattgtaaagagagcaacatccctttcaattccaaggacagtcacacagatgaacctggaattaaaaagtgcttgaatcctgaagaaaaaactggtgcattcaagacagcgtcaacttcattcgaagccagtaaccacaaattcttagacagaatgtcaccatttggctccttggtaccagtggaatgctacaaagttagccttggaaagacagatgcgttcatatgtaaatataagaagtcgcactcttctggactgtag

SEQ ID NO: 31569 - DNA, 996 bp, Homo sapiens
gtaatgcgagaggtgcgggcgcggctggcggccacgcaggttgaatatatttcaggaaaggtttttttcaccacctgttctgatttgaatatgttgaagaaattaaaatctgcagaaagattatttttgctgattaaaaagcagtttccacttattatttcttctgtaagtaaaggaaaaatatttaatgaaatgcaaagacttataaatgaagatccaggaagttggttgaatgccatttcaatttggaaaaatcttcttgaacttgatgcaaaaaaggaaaaactttctcagagagatgataaccaactaaaaagaaaagtgggagaaaatgaaatcattgcaaagaaattaaaaatagaacaaatgcaaaagatagaagagaatagggactgccagctggaaaaacaaataaaagaagaaactctggagcaaagagattttaccactaaaagcgaaaagtttcaagaagaagaatttcagaatgacatagagaaagcaattgatactcataatcagaatgacttgactttcagagtatcttgtcgctgcagtggaactattggaaaggccttcactgcacaggtcctgtacatgggattgtcaccaggacctagactgcaaatgcacatgaggtctcagcaatgtagagaagagcgaacaccacaaactgttgccatcaccagacctcatcagttggcccttacaaagttcagtgatgttaaaggccattggtctgaatactttatcaaccttaaaatcagtcaaaccctaaagggaggtaggaaaagtaattggaattgctattatgaaacactttggatggaaagcagacttgaggaatccacaattagagatctttatacatctaaatgacatttactctgtggtggggattcctgtgttcagggtttccctagccagcagagcttacatcaagacagctggactgcgatctacaatagcgtgggcaatggcatctctggctgacattaa

SEQ ID NO: 31570 - DNA, 1970 bp, Homo sapiens
gaaggcgcgagggcgcgcctgagccgccatgtcggaggcgcgtggagagccagggtccgggcctgaggctggcgcccgattcttctgcactgcgggtcgcggcctggagccgttcgtaatgcgagaggtgcgggcgcggctggcggccacgcaggttgaatatatttcaggaaaggtttttttcaccacctgttctgatttgaatatgttgaagaaattaaaatctgcagaaagattatttttgctgattaaaaagcagtttccacttattatttcttctgtaagtaaaggaaaaatatttaatgaaatgcaaagacttataaatgaagatccaggaagttggttgaatgccatttcaatttggaaaaatcttcttgaacttgatgcaaaaaaggaaaaactttctcagagagatgataaccaactaaaaagaaaagtgggagaaaatgaaatcattgcaaagaaattaaaaatagaacaaatgcaaaagatagaagagaatagggactgccagctggaaaaacaaataaaagaagaaactctggagcaaagagattttaccactaaaagcgaaaagtttcaagaagaagaatttcagaatgacatagagaaagcaattgatactcataatcagaatgacttgactttcagagtatcttgtcgctgcagtggaactattggaaaggccttcactgcacaggaggtaggaaaagtaattggaattgctattatgaaacactttggatggaaagcagacttgaggaatccacaattagagatctttatacatctaaatgacatttactctgtggtggggattcctgtgttcagggtttccctagccagcagagcttacatcaagacagctggactgcgatctacaatagcgtgggcaatggcatctctggctgacattaaggctggtgcatttgttttagatccaatgtgtggacttggaacaatacttttggaagctgctaaagaatggccagatgtgtattatgtaggtgctgatgtcagcgactcacagttactaggtacttgggacaatctgaaagctgcaggccttgaggataaaattgaattacttaaaatctctgttatagaattgccattgccttcagaaagtgttgatattattatttctgacattccatttgggaaaaagtttaagttaggaaaagacatcaaaagcattctacaagaaatggaaagagtgcttcatgttggcggaaccattgtattgttgcttagtgaagatcaccacaggcgccttacagattgtaaagagagcaacatccctttcaattccaaggacagtcacacagatgaacctggaattaaaaagtgcttgaatcctgaagaaaaaactggtgcattcaagacagcgtcaacttcattcgaagccagtaaccacaaattcttagacagaatgtcaccatttggctccttggtaccagtggaatgctacaaagttagccttggaaagacagatgcgttcatatgtaaatataagaagtcgcactcttctggactgtagcaggcttgctgccatcagccgggttcaggcccttgtaagttagctgtacagcagaagtttgctgtctctaggattcatatagcacccacagagctccaagtaaccaaattcccccaaagacaggaggtgtggctgatgggtacacatgcttggtaagagtttctgctttatattctaaagtacttaatgtttttgagaaaaaagttatcgaatattttttagacttaagttttatcttctgtcagaatgtgaaaagttctgcccagtttctgagcaaaaacttcaatttcaaaataaaggttttcaggggttcacttaagtgtatcacaatcaacaccagacgggatattttaactatcagattttcggaaatgtaaaaacctttatgtgtaacttcttttgatattaaacttgatttttgagcctgtaa

SEQ ID NO: 31571 - DNA, 3554 bp, Homo sapiens
actaggcagggatgagcaagaggaatggctcacccttgagagctggggtccatagcccaggtcagttctccagctctcccacttaccagccaagacaggaggtgaggattgagatgggatgaacccagcaggcggccatgggttaaaggtcgccatgaatgtaatgtgcccagcacagtgcctgctaaaaggcaacactcccttcctggtctgaagaccaaacaagcagactgtactcaggaaagccagaagaaccttccagctgtctggaccagaaggtgccagcccaggggctgaagaagacgtaatgcccagagcaaaaagcgcctgcagccccctgaagggctgggtgctctggaatagatgagggggcgaaatggggctggggaccagggacggacagggtgggtccagcacctgcctcgcttccgaagggctgctccaacactgaaaaacacccaaccagcttcctttcagaaagactggaatattccaaaacttctcactggaggctccggaggaggtgggctccagctgaaaaggaaatgtggaggcgtgggcgctcccggcctgcatcctgcacctcttacactttggttttcccacagactcctgaagaataggtcagaagaaagggttaaagccttaaaaggggaacaaccattgcggggctcagggaggaggataatgttctttgggctgccgcaccctgatccccggggtcccgaaccctcccgtccctggccaggcctgccagccacagggtgagggcccccttccgccgcaacctgccactctcacaccaatgcgggaccgccttctcttccttccccaccccccaccccaccctgccgtcctttctcccccaatctccgcctctgattggctgagcccccggctccccgctccccctctcctccatccccggtgaaaactgcgggctccgagctgggtgcagcaaccggaggcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccccaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctgtcctcgtgtccacctggccttcgctcctccagcagtgcctgcctgcccccgcttcgctggggtctccacgggtgaggctggggaacgccacctcttcctcttccctgacttctccccaaccacttagtagcaacgctaccccaggggctaatgactgcacactgggcttcttttcagaatgaccctaacgagacacatttgcccaaataaacgaacatcccatgtctgctgactcacctggctggaacaacatgcttactgccaacatgtgggccgaaccacatggccctggctctggaatgcacaagtggctttgcgtgaatctgcgctaagctatgcagtctgctttttcttctcagctctggtagttcttcagaaatgtaccctccaggcacatccactattgcgagggtgagcacgaagggtgggagatgcccatgtcctcaaggcatcacttcctaaatccaaaagcatcggcaggagaaaggactggggacaaatactgtcccttcgggagtagggagggaacactgaggcccatccctggctccttccctaaaagtagagtaaaatggaagcgagcatcctgggattgggggcaagagggggaccgcagggtagctgtgggttccaactgctgtcagagtcagagaggcagccccaagccagcctccctgctttgccagggaatttgggggaggaaggtgacagctgcccagaggctgactcatctgatatttagcactgggtaggatgattgtttctgagcatttttcttaaaggcctcagatctaaat

SEQ ID NO: 31572 - DNA, 2050 bp, Homo sapiens
tttgggaaaggagaggattggaatacggaaatggattaaggatgaggcccgccgggggcttgagagggaggaagagcagaccttctctgggtctggagccgcctgaggacacagaccagaggaaatgaatacagactgcacctccccagccgctctccacccctcccctggctcttctaccctctccagccccagacccatttcttccctttcttgctctggccattgctcccccttcccctcctagatcccaagcccgcacaacatctcaaacaagagtcctcgattcaaaagccagatgccgaccccccttcctcctggatctggctcagggcagcagctccaccccgggacagagagagcattgattgtagctgcagccgccgcgggatcctagcctcacccgtcaaggggctgagcgccagggaccctgaactcgtctagtggtgcgccctgcgcacccgggcgcactcaaccgaggcaatgccctgcgcgctctcgcgggtgcacgccccttctgtggcctctcctgggcgagcactgctctgcagataggctagactaccggctccgcgtcgcctcgccaagggttggttcagccaaggctgcaaaaaacaaaaaaagaccaggcagacagcctatccagggtggctattgaaactgggctggaaaactgcagtcccaggaactccagagagctggacattgggaagcatccttggctcacatacaatcggagatcactatgtctttctctcctccaggaacacgattagcttgtgtcctatccagataggaatagatgctccctatctgggagcatccttagctatggtgaatggtatctagccatccactggggatggcgagtgacttagggatttgtgtctcacgtatatgaagcagtcatcgccagatgttggttgtttttcttaacccccatcataacccgatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccccaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaacc

SEQ ID NO: 31573 - DNA, 736 bp, Homo sapiens
gcagccagaaagctctggagcatcagggagactccaacttaaggcaacagcatgggtgaataagggcttcctgtggactggcaatgagaggcaaaacctggtgcttgagcactggcccctaaggcaggccttacagatctcttacactcgtggtgggaagagtttagtgtgaaactggggtggaattgggtgtccacgtatgttcccttttgccttactatatgttctgtcagtttctttcaggaaaatcttcatcttacaacttgtagggctggtgttaacttacgacttcactaactgtgactttgagaagattaaagcagcctatctcagtactatttctaaagacctgattacatatatgagtgggaccaaaagtaccgagttcaacaacaccgtctcttgtagcaatcggccacattgccttactgaaatccagagcctaaccttcaatcccaccgccggctgcgcgtcgctcgccaaagaaatgttcgccatgaaaactaaggctgccttagctatctggtgcccaggctattcggaaactcagataaatgctactcaggcaatgaagaagaggagaaaaaggaaagtcacaaccaataaatgtctggaacaagtgtcacaattacaaggattgtggcgtcgcttcaatcgacctttactgaaacaacagtaaaccatctttattatggtcatatttcacagcaccaaaataaatcatctttattaagta

SEQ ID NO: 31574 - DNA, 2411 bp, Homo sapiens
accctcgccacgcccctgctcccccgcggttggttcttccttgctctactcaaccctgacctcttctctctgactctcgacttgtgttccccgctcctccctgaccttcctcccctcccctttcactcaattctcaccaactctttctctctctggtgttttctccttttctcgtaaactttgccgcctatgagcagccacattgccttactgaaatccagagcctaaccttcaatcccaccgccggctgcgcgtcgctcgccaaagaaatgttcgccatgaaaactaaggctgccttagctatctggtgcccaggctattcggaaactcagataaatgctactcaggcaatgaagaagaggagaaaaaggaaagtcacaaccaataaatgtctggaacaagtgtcacaattacaaggattgtggcgtcgcttcaatcgacctttactgaaacaacagtaaaccatctttattatggtcatatttcacagcaccaaaataaatcatctttattaagtagatgaaacattaactctaactgtgacaaagaagaccacaaatagttatcttttaattacagaagagtttcttaacttacttttgtaagtttttattgtgtaagtttataatgcaggggaagtactactcctcaaatgttgagggaagcttccataacattgatgactggcttcatggcagtaattctcggctgtagttgcataagcattgctcaagaggaaaatccaaaagtgcagcaggagaactcttttccctgaaaaaggaaaaatattgaactcaatgatagcacctaaacttacatttaaaagacagacattccttctacatgtaatgacacttcttgtgttaaactaaaaatttacaagagaagaaagtgaaagcaaatggggtttcacaaatagttgtaaatatagtgaagcaatttgaaataattttcaagcaaagtattgtgaaagtattctaagccaagttttaaatattatctaacagacaagagtggtatatacaagtagatcctgagaagtacctttgttacagctactataaatatacatataaattatagaatctactttaatttattttgtgaacacttttgaaaatgtacatgttcctttgtaattgacactatatatttcttaataaaataattctcaaatttgtttcttatgaatcatctctcaaatctagttagacaatttgcacacatacttttctaagggacattatcttccttcaggtttttacctccactcatccttagagcccactgactgctcccctttatacctgttggccctgcctataggagagaatatttggagataggcagcttcaggatgcattgcaatcatccttttcttaaattatgtcactagtcttttattttttcccctcttgaactttcctcacacctggaagaaacaaagtaggaaaaagtgaacaggggatgtcaaatcgattcttgaattcccgctgcaagctagagccgcaggcaccctctcactcaatttccactcagaaccctataaacaccagtgggaagggcaacccactgcacgtgggaatgcactgatttttcctaggagtagacatgttcctctaattactccctgagggttagttggggctaaaccatgacagaagtggggaagttcaatgtccttaaatccatcttacttgccaacaggtaagaggaagcttacattacatgtccagtccacatttaaagagcacttactgtggaacaagccttcagccaaacaatggggatagaaaagtaggtaagactcagcctttgtccagagaagctcagggtatagctgaataggcagtttcttttgtcctgaggaaaatcaggacatgcctgctttctaaaaatcttcctctgaagacctgacccaagctcttaaatgctattgtaagagaaatttctttgtctattaactccattttagtagggattcactgactagattttactgaactatgaaaataaatacacataatttttcacaaaattttgggcccaattcccctaaaagaattgaggattagggagaaaggagacaactcaaagtcatcccattaagtgcagtttctttgaatcttctgctttatctttaaaaatttgtataatttatatattttattctatgtgttccatagatatcttaatgtaaaattagtcatttaaattacactgtcaattaaaagtaatgggcaagagattgcatcatactaatttagtaagaacgttcccaaatgttgtaacaatgtggatcatacatctctggttttttaaatgtattgaggctttcttggtggactagtatagtatacggtcagttatgtcaatgtttcatggtcaataaaaaggaagttgcaaattgt

SEQ ID NO: 31575 - DNA, 1624 bp, Homo sapiens
cctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcctggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcactgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactggttggtgga

SEQ ID NO: 31576 - DNA, 1028 bp, Homo sapiens
gagagtactcgggttcgtgaacttcccggaggcgcaatgagctgcattaacctgcccactgtgctgcctggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcactgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattc

SEQ ID NO: 31577 - DNA, 5114 bp, Homo sapiens
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattgctggtcctgaagctttggaggtgggcagagagagcttcaagaagactagatgcaaaccctggaaaggattaaggctcaactctggagaaacaggccacagcctctcagagcagctgttggctgtaaatagaggtagcaaggccgctcccaggcccctgtgagtgtgggcacctgtgcatgcaatgctccgactctgcagaggtgccaagtgcccctgctgggccagtcccagagagttaggaagtcaaggcctgcaactcctggttcttcctgtttggaccagttcttgtgccattggcaggatgagaggcagcagccaggcgggagctgtgtctagcagcacctgtagcccacgtgctgctaattagctggaaaactggcgaaggcagaacctttgctaccaggaatcttgacatgtggggtctgtctttgagaatttgtaaatgaacagtccaatatttcctctcggctcattttgcacatccatttttggggaaatgtgatttctctctctttttttttttttttttttgcctaaggcacaatctcaagaggtcctgagaccacgtacccatgatttttttcttgctctgtgatacccaataactccttcacctaagccctgttgttgattttgaagtgcttcctaggccagtgattttagcttctgccagctgcttttgccagtagattaacgtgtttttatttttcaaactccgtgtttcctaacgtggagtgtatgggtctaagagagcctgctgtcctccctgccttccaccttggagaggaggctggacgcatcagcagtggccagggcaggtcgcaaaatctcccagcctagagaccacacctgaaacggctgaagccagcttgcacaagggctgctgtccctctgcggcaggcagagctggtgggggcaggggtcacagagcagtcatagacaccatggaccagggcaggagaagggcagatggcacatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataccttatgtacctggttttttttggaaactagatagaaatatatttatcttttacataaaagaagtgtgtagtggggtggtccagggctttgtggtggcttagtggccatcggggtcccaggctcttcccacctttctcttttgggtccacctcttggctcctggcttccttcctctggggcctgactgtccaggatggcagctggagctcctgctctgggcacggttggcatcagagcccactgctccccatccactctttaatccagatgctggtaatgtccctttccaaggcataactaagataagctggaaggttcttacgaggctttgctagaggccctgggaggtggggggaaaggcaagagggcagtgcccacccatagaccgggtcacatgacctggcatcagcgccgtggggtcctttgggcttcacctccctctcccctctgcccccacgtcatcccaccctcatcctcaccctcaccattcccatcccgtaccgtaatgtcccttgcaaggcctaactctgtgaggaatgaaaccacctcatccttgttccaataacatgagtgaccgaatttacaaacgagtgaatgtggacctctggaaacattacccagcttgtttttacttttcactttctctttctgcccctttcatttccgtaggagccctttacctagatgagaagtgtccccccgcctggggaatatatcagtcagaacaatcttcctgcagacatgcaccattagacccgagtgacggtggtgccatttaaacctcagagcaggtaaaaggtggtcctgaaacctgtctacccacagggtgctatggaatctgaatcacttcttttttcctagagccctggggtggggagctccctcaagtgttcacatgtgtgtggaatgaggaacacccatctccttggccctctccaccctgaagagttagttattaaaataattggcaagctcttgcaaatgtcagtcatccattgttcagaatggaatagcaataatacatccctggctgccctgggcttggccaggattactcactgaaggcctcagggttactggcacacactttcttttcctaataatcccatcccctcagctttcctaaggctagagtgaatttcgtgttcctttagtttacataagatggtgaacttggcaaaagctatcattaaacagaagctaagagaaagcctatgtcgtggaatccagaatgggtattgccattcactgctgtccacagaagctgtcttgaatttctttctgtgtcttttctttttttttctttaagactgttgtttaccagactgggctctgtggaacacaggtgtcctgggagatggttaatcattacaaaatattggtaacaatctaaagatgcatacataagagagtggtcaaataaaccattttccattca

SEQ ID NO: 31578 - DNA, 5060 bp, Homo sapiens
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgatctgtgtcgagggcaatattgcaagtgggaagacgacatgcctggaattcttctccaacgcgacagacgtcgagggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattgctggtcctgaagctttggaggtgggcagagagagcttcaagaagactagatgcaaaccctggaaaggattaaggctcaactctggagaaacaggccacagcctctcagagcagctgttggctgtaaatagaggtagcaaggccgctcccaggcccctgtgagtgtgggcacctgtgcatgcaatgctccgactctgcagaggtgccaagtgcccctgctgggccagtcccagagagttaggaagtcaaggcctgcaactcctggttcttcctgtttggaccagttcttgtgccattggcaggatgagaggcagcagccaggcgggagctgtgtctagcagcacctgtagcccacgtgctgctaattagctggaaaactggcgaaggcagaacctttgctaccaggaatcttgacatgtggggtctgtctttgagaatttgtaaatgaacagtccaatatttcctctcggctcattttgcacatccatttttggggaaatgtgatttctctctctttttttttttttttttttgcctaaggcacaatctcaagaggtcctgagaccacgtacccatgatttttttcttgctctgtgatacccaataactccttcacctaagccctgttgttgattttgaagtgcttcctaggccagtgattttagcttctgccagctgcttttgccagtagattaacgtgtttttatttttcaaactccgtgtttcctaacgtggagtgtatgggtctaagagagcctgctgtcctccctgccttccaccttggagaggaggctggacgcatcagcagtggccagggcaggtcgcaaaatctcccagcctagagaccacacctgaaacggctgaagccagcttgcacaagggctgctgtccctctgcggcaggcagagctggtgggggcaggggtcacagagcagtcatagacaccatggaccagggcaggagaagggcagatggcacatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataccttatgtacctggttttttttggaaactagatagaaatatatttatcttttacataaaagaagtgtgtagtggggtggtccagggctttgtggtggcttagtggccatcggggtcccaggctcttcccacctttctcttttgggtccacctcttggctcctggcttccttcctctggggcctgactgtccaggatggcagctggagctcctgctctgggcacggttggcatcagagcccactgctccccatccactctttaatccagatgctggtaatgtccctttccaaggcataactaagataagctggaaggttcttacgaggctttgctagaggccctgggaggtggggggaaaggcaagagggcagtgcccacccatagaccgggtcacatgacctggcatcagcgccgtggggtcctttgggcttcacctccctctcccctctgcccccacgtcatcccaccctcatcctcaccctcaccattcccatcccgtaccgtaatgtcccttgcaaggcctaactctgtgaggaatgaaaccacctcatccttgttccaataacatgagtgaccgaatttacaaacgagtgaatgtggacctctggaaacattacccagcttgtttttacttttcactttctctttctgcccctttcatttccgtaggagccctttacctagatgagaagtgtccccccgcctggggaatatatcagtcagaacaatcttcctgcagacatgcaccattagacccgagtgacggtggtgccatttaaacctcagagcaggtaaaaggtggtcctgaaacctgtctacccacagggtgctatggaatctgaatcacttcttttttcctagagccctggggtggggagctccctcaagtgttcacatgtgtgtggaatgaggaacacccatctccttggccctctccaccctgaagagttagttattaaaataattggcaagctcttgcaaatgtcagtcatccattgttcagaatggaatagcaataatacatccctggctgccctgggcttggccaggattactcactgaaggcctcagggttactggcacacactttcttttcctaataatcccatcccctcagctttcctaaggctagagtgaatttcgtgttcctttagtttacataagatggtgaacttggcaaaagctatcattaaacagaagctaagagaaagcctatgtcgtggaatccagaatgggtattgccattcactgctgtccacagaagctgtcttgaatttctttctgtgtcttttctttttttttctttaagactgttgtttaccagactgggctctgtggaacacaggtgtcctgggagatggttaatcattacaaaatattggtaacaatctaaagatgcatacataagagagtggtcaaataaaccattttccattca

SEQ ID NO: 31579 - DNA, 3738 bp, Homo sapiens
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattgctggtcctgaagctttggaggtgggcagagagagcttcaagaagactagatgcaaaccctggaaaggattaaggctcaactctggagaaacaggccacagcctctcagagcagctgttggctgtaaatagaggtagcaaggccgctcccaggcccctgtgagtgtgggcacctgtgcatgcaatgctccgactctgcagaggtgccaagtgcccctgctgggccagtcccagagagttaggaagtcaaggcctgcaactcctggttcttcctgtttggaccagttcttgtgccattggcaggatgagaggcagcagccaggcgggagctgtgtctagcagcacctgtagcccacgtgctgctaattagctggaaaactggcgaaggcagaacctttgctaccaggaatcttgacatgtggggtctgtctttgagaatttgtaaatgaacagtccaatatttcctctcggctcattttgcacatccatttttggggaaatgtgatttctctctctttttttttttttttttttgcctaaggcacaatctcaagaggtcctgagaccacgtacccatgatttttttcttgctctgtgatacccaataactccttcacctaagccctgttgttgattttgaagtgcttcctaggccagtgattttagcttctgccagctgcttttgccagtagattaacgtgtttttatttttcaaactccgtgtttcctaacgtggagtgtatgggtctaagagagcctgctgtcctccctgccttccaccttggagaggaggctggacgcatcagcagtggccagggcaggtcgcaaaatctcccagcctagagaccacacctgaaacggctgaagccagcttgcacaagggctgctgtccctctgcggcaggcagagctggtgggggcaggggtcacagagcagtcatagacaccatggaccagggcaggagaagggcagatggcacatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataccttatgtacctggttttttttggaaactagatagaaatatatttatcttttacataaaagaa

SEQ ID NO: 31580 - DNA, 1178 bp, Homo sapiens
tttcctccccggctgcggctgggacgggggcggccatcggccgttacccgggcgcgagaccgcagcgagcgctgggggcgctcggctttggttctgggatggagagagggcctttaaagagcaggacggacacgctctgaacattccggcccaaactcggtcccccgacccatttcctgtcccgattctttcgaccttgggggcgatggggactgggagctgccttaagccgattctgctcacactctgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatg

SEQ ID NO: 31581 - DNA, 1937 bp, Homo sapiens
gccaagttatgggtgcgttctgccagcgtcctagcagtgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcatt

SEQ ID NO: 31582 - DNA, 2687 bp, Homo sapiens
gggcggccatcggccgttacccgggcgcgagaccgcagcgagcgctgggggcgctcggctttggttctgggatggagagagggcctttaaagagcaggacggacacgctctgaacattccggcccaaactcggtcccccgacccatttcctgtcccgattctttcgaccttgggggcgatggggactgggagctgccttaagccgattctgctcacactctggtgccagcgtgggggaggggggttacgcccccggcgctctcctgccctccctgggagtggggacccacacagaaacgggtcactgttacacccgggttctggtgtccgccatatggctgttgagagacgcctcagaaccacctgtgggacggatgggcagcgatgcccgccctgggcctagaggaacacctgggtcccaggcccaaaaccacgtccgccgcccactcttccccgtgcaccgcgagtggaggctgttctgcctttccacttgcttaacatccagtctgtgaagatctaaataaataacgtggaaaatgcaaagtataatgtactaagtgaaagaactcgagcacactgggggtccacgaagctgcagctgcagcccagggtggcacatcggcgagacggtggtgcgcgcctccaatctcggagggcgcccaaaatggaaaatgtttttaggccagggagtgagcataaacattagtgtttttgtggtcatgtagcaaattagggcagaggagagttatttaaaagtgagtttaaaaactgatttcctttcttttgtagataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcatt

SEQ ID NO: 31583 - DNA, 2266 bp, Homo sapiens
agtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgagacggcgtcttgctgtgttgcccaggctggcctccaactcctgggctcaagtgatcctctggcatcagcctcctgagtagctgtgatgacaagtatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagc

SEQ ID NO: 31584 - DNA, 5039 bp, Homo sapiens
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattgctggtcctgaagctttggaggtgggcagagagagcttcaagaagactagatgcaaaccctggaaaggattaaggctcaactctggagaaacaggccacagcctctcagagcagctgttggctgtaaatagaggtagcaaggccgctcccaggcccctgtgagtgtgggcacctgtgcatgcaatgctccgactctgcagaggtgccaagtgcccctgctgggccagtcccagagagttaggaagtcaaggcctgcaactcctggttcttcctgtttggaccagttcttgtgccattggcaggatgagaggcagcagccaggcgggagctgtgtctagcagcacctgtagcccacgtgctgctaattagctggaaaactggcgaaggcagaacctttgctaccaggaatcttgacatgtggggtctgtctttgagaatttgtaaatgaacagtccaatatttcctctcggctcattttgcacatccatttttggggaaatgtgatttctctctctttttttttttttttttttgcctaaggcacaatctcaagaggtcctgagaccacgtacccatgatttttttcttgctctgtgatacccaataactccttcacctaagccctgttgttgattttgaagtgcttcctaggccagtgattttagcttctgccagctgcttttgccagtagattaacgtgtttttatttttcaaactccgtgtttcctaacgtggagtgtatgggtctaagagagcctgctgtcctccctgccttccaccttggagaggaggctggacgcatcagcagtggccagggcaggtcgcaaaatctcccagcctagagaccacacctgaaacggctgaagccagcttgcacaagggctgctgtccctctgcggcaggcagagctggtgggggcaggggtcacagagcagtcatagacaccatggaccagggcaggagaagggcagatggcacatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataccttatgtacctggttttttttggaaactagatagaaatatatttatcttttacataaaagaagtgtgtagtggggtggtccagggctttgtggtggcttagtggccatcggggtcccaggctcttcccacctttctcttttgggtccacctcttggctcctggcttccttcctctggggcctgactgtccaggatggcagctggagctcctgctctgggcacggttggcatcagagcccactgctccccatccactctttaatccagatgctggtaatgtccctttccaaggcataactaagataagctggaaggttcttacgaggctttgctagaggccctgggaggtggggggaaaggcaagagggcagtgcccacccatagaccgggtcacatgacctggcatcagcgccgtggggtcctttgggcttcacctccctctcccctctgcccccacgtcatcccaccctcatcctcaccctcaccattcccatcccgtaccgtaatgtcccttgcaaggcctaactctgtgaggaatgaaaccacctcatccttgttccaataacatgagtgaccgaatttacaaacgagtgaatgtggacctctggaaacattacccagcttgtttttacttttcactttctctttctgcccctttcatttccgtaggagccctttacctagatgagaagtgtccccccgcctggggaatatatcagtcagaacaatcttcctgcagacatgcaccattagacccgagtgacggtggtgccatttaaacctcagagcaggtaaaaggtggtcctgaaacctgtctacccacagggtgctatggaatctgaatcacttcttttttcctagagccctggggtggggagctccctcaagtgttcacatgtgtgtggaatgaggaacacccatctccttggccctctccaccctgaagagttagttattaaaataattggcaagctcttgcaaatgtcagtcatccattgttcagaatggaatagcaataatacatccctggctgccctgggcttggccaggattactcactgaaggcctcagggttactggcacacactttcttttcctaataatcccatcccctcagctttcctaaggctagagtgaatttcgtgttcctttagtttacataagatggtgaacttggcaaaagctatcattaaacagaagctaagagaaagcctatgtcgtggaatccagaatgggtattgccattcactgctgtccacagaagctgtcttgaatttctttctgtgtcttttctttttttttctttaagactgttgtttaccagactgggctctgtggaacacaggtgtcctgggagatggttaatcattacaaaatattggtaacaatctaaagatgcatacataagagagtggtcaaataaaccattttccattca

SEQ ID NO: 31585 - DNA, 840 bp, Homo sapiens
atgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttag

SEQ ID NO: 31586 - DNA, 693 bp, Homo sapiens
atgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttag

SEQ ID NO: 31587 - DNA, 1662 bp, Homo sapiens
cgggacggccgcgggaaaaggcgcgcggaaggggtcctgccaccgcgccacttggcctgcctccgtcccgccgcgccacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaa

SEQ ID NO: 31588 - DNA, 1299 bp, Homo sapiens
tgcggcgcagcggaggcggaccgcagtcgagtctgcagagtgttgggtctgtagccagcaaattacttcatcatctagattatccattcagttgatcctaattagcaaggataacaaggtaacacaaggcttacttatattcacccaacaaaagtgtctctgtggagccacttcccagtgaactacatactgagataggggttcctggatgagaaggaccaaggacagaaccgagaagagtttaggggcaggttatgcgagatggaaatggcgcagataacggagggaaggatttgagggctcaaacgtaggcgtctgtgtttcgcaaaagttggagacgttctaggctgcctctcgttgcctccatctcgctctgcgcgggttttggaggacattagcattctttcttgtatctccgttgattccagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 31589 - DNA, 835 bp, Homo sapiens
acagcctgcggcgcagcggaggcggaccgcagtcgagtctgcagagtgttgggtctgtagccagcaaattacttcatcatctagattatccattcagttgatcctaattagcaaggataacaagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatgaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaa

SEQ ID NO: 31590 - DNA, 943 bp, Homo sapiens
cgccgcgggggtcgcgctgcacagcctgcggcgcagcggaggcggaccgcagtcgagtctgcagagtgttggaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 31591 - DNA, 893 bp, Homo sapiens
cctaattagcaaggataacaagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 31592 - DNA, 3866 bp, Homo sapiens
agctactccaccccactctggctgtagtgtgacattcctgcctgcctgaggaagaaatggtgagcaggggctgcaattgcagacaagtgtcacccagaagccacaagtttctgtgagcaccaggtctacaaactacccaaggcatagcaatggcattatcactggaagaattcgtccactcccttgacctcaggaccctacccagggttctagaaatccaggcaggcatctatcttgaaggctctatttatgaaatgtttggaaatgaatgctgtttttcaacaggagaagtgattaaaattactggtctcaaagttaagaagatcatagctgaaatttgtgagcagattgaaggttgtgagtctctacagccatttgaactgcctatgaattttccaggtctttttaagattgtggctgataaaactccataccttactatggaagaaatcacaaggaccattcatattggaccaagtagactagggcatccttgcttctatcatcagaaggatataaaactagagaacctcatcataaagcagggtgagcaaatcatgctcaactcagttgaagagattgatggagaaataatggtgagctgtgcagtagcaaggaatcatcaaactcactcatttaatttgcctttgtcacaagaaggagaattctacgagtgtgaagatgaacgtatttacactctaaaggagattgttgaatggaagattcctaagaacagaacaagaactgtaaaccttacagatttttcaaataagtgggactcaacgaatccatttcctaaagacttttatggtaccctgattctcaagcctgtttatgaaattcaaggtgtgatgaaatttcgaaaagatataatccgcatcctccccagtctagatgtcgaagtcaaagacatcactgattcttacgatgctaactggtttcttcagctgttatcaacagaagatctttttgaaatgactagtaaagagttccccatagtgactgaagtcatagaagcacctgaaggaaaccacctgccccaaagcattttacagcctgggaaaaccattgtgatccacaaaaagtaccaggcatcaagaatcttagcttcagaaattagaagcaattttcctaaaagacacttcttgatccccactagctataaaggcaagttcaagcggcgaccgagggagttcccaacggcctatgacctagagatcgctaagagtgaaaaggagcctcttcacgtggtggccaccaaagcgtttcattcccctcatgacaagctgtcatccgtatctgttggggaccagtttctggtgcatcagtcagagacgactgaagtcctctgtgagggaataaaaaaagtggtgaatgttctggcctgtgaaaaaatcctcaaaaagtcctatgaggctgcgctgctccctttgtacatggaaggaggttttgtagaggtgattcatgataagaaacagtacccgatttctgagctctgtaaacagttccgtttgcccttcaatgtgaaggtgtctgtcagggatctttccattgaagaggacgtgttggctgccacaccaggactgcagttggaggaggacattacagactcttacctactcataagtgactttgccaaccccacggagtgctgggaaattcctgtgggccgcttgaatatgactgttcagttagttagtaatttctctagggatgcagaaccatttctagtcaggactctggtagaagagatcactgaagagcaatattacatgatgcggagatatgaaagctcagcctcacatcccccacctcgccctccgaaacacccctcagtagaggaaacaaagttaaccctgctaaccttagcagaagaaaggacggtagacctgcccaagtctcccaagcgtcatcacgtagacataaccaagaaacttcacccaaatcaagctggcctggattcaaaagtactgattggtagtcagaatgatttggtggatgaagagaaagaaaggagcaaccgtggggccacagcaatagcagaaacattcaaaaatgaaaaacatcaaaaataacaagatgtgacagaagccacttaggcagcaaacataaatgttgcagtgaaaaaagaagctagccttctagctgaaaaacgagtattccccaatggactccagaagaaacttgattcatcgctgcaaaggaaagaacaaccttaaaacttttaacagataaaacttacagaaacctatgatatagaattcatatagtctattctgttgtgtctaaatctgtaggcattgtgttgttgttctttaggacgtatttatttaacttgcacattttttcagattcttatttctactaccaacaactaagtaattgggaaataattctgtatttcagtttctgagtaaaaccagtctgaaataggataaaagccaccaaatattttcttttttttccagaatttgttttgccattttttagtgctatcatcattcctaacaagactaacttacagaaaaataattatatctgactgatttaaaatgttcaggtttcttatccaaatcccttggaactatggaaaggagtttgatttcacattcacagtgtatttacaaaatacgctgtgtcataaatatgtttgaattccaacagccaaagccattgagagtcataggagttttccataaccttctcttctatgacccaacaacaagctcatgactgaaatttcaccagatttctgagacgatgtcttaatattctatgtgctatgtaccagataattctttagatgaatgtttcttaggattgtaggaaaattatctagttaatcataatatttgatggaaagaaaaagacaataaaattgtaatataataaatttggctgacaagaaaccaaagtgattcttaattagtatacatcagaatgatgctcttatagttgtaccatctataaaaattactttaagggctctcacattttaataatttatcttattatgtattaagtatacaggaacaatattatttttcctttaacaaaatgaagagacaggctatctggttaatgttacataggaatttaatagtaatgcttgaacttcatccatagatcatactctgtacaaaatttgttagctaacatcctatctcataattattttatgttttgtggagaaatttgttgattttgtaccaaagtgtttctgaagacaataaattgtgagtcaactttagaacaaaaaaaattagagttttttcaatgtttatattctgattaagcttactttaccttacattttttctaagtaacaatgaatcctgatttctagtgtcctaaaaattgcttagtgatttgattgtggtaatatcatttcttatctacaatgtctaaagttttatgggacagtttttcttttatttattttgcctgtttgtgcagataagaacagaaacttttctaagacccacatttggttattgaaggccacagcgaatcttaacctaacagccttgacaaactgcaccataggtgtttttagactcatataatttgttatttttcaaacaatagtgaataattaatatttttgtttggaatttgagaacaattaaatttgtacttttagtaactaccattctttgattagaaaattaagagaatgcatatcttactttggttgtaaattatcaagggctttctaatagaaatcatatataacatttctaaatataagtcctttcacatactgtgtttccagttgtcttgatattgaaaagtgtaataaacttcatgctcacctattggagatttgggaaggttgaaaataaacttcctaatttttatttgta

SEQ ID NO: 31593 - DNA, 4101 bp, Homo sapiens
tgagaggctcttcctggatcccttattttctacaggagaggaggaaaacacctgggatgctccagtgctcttacgcagataatgatcattaacatcagcctctctgatcaaagagctactccaccccactctggctgtagtgtgacattcctgcctgcctgaggaagaaatggtgagcaggggctgcaattgcagacaagtgtcacccagaagccacaagtttctgtgagcaccaggtctacaaactacccaaggcatagcaatggcattatcactggaagaattcgtccactcccttgacctcaggaccctacccagggttctagaaatccaggcaggcatctatcttgaaggctctatttatgaaatgtttggaaatgaatgctgtttttcaacaggagaagtgattaaaattactggtctcaaagttaagaagatcatagctgaaatttgtgagcagattgaaggttgtgagtctctacagccatttgaactgcctatgaattttccaggtctttttaagattgtggctgataaaactccataccttactatggaagaaatcacaaggaccattcatattggaccaagtagactagggcatccttgcttctatcatcagaaggatataaaactagagaacctcatcataaagcagggtgagcaaatcatgctcaactcagttgaagagattgatggagaaataatggtgagctgtgcagtagcaaggaatcatcaaactcactcatttaatttgcctttgtcacaagaaggagaattctacgagtgtgaagatgaacgtatttacactctaaaggagattgttgaatggaagattcctaagaacagaacaagaactgtaaaccttacagatttttcaaataagtgggactcaacgaatccatttcctaaagacttttatggtaccctgattctcaagcctgtttatgaaattcaaggtgtgatgaaatttcgaaaagatataatccgcatcctccccagtctagatgtcgaagtcaaagacatcactgattcttacgatgctaactggtttcttcagctgttatcaacagaagatctttttgaaatgactagtaaagagttccccatagtgactgaagtcatagaagcacctgaaggaaaccacctgccccaaagcattttacagcctgggaaaaccattgtgatccacaaaaagtaccaggcatcaagaatcttagcttcagaaattagaagcaattttcctaaaagacacttcttgatccccactagctataaaggcaagttcaagcggcgaccgagggagttcccaacggcctatgacctagagatcgctaagagtgaaaaggagcctcttcacgtggtggccaccaaagcgtttcattcccctcatgacaagctgtcatccgtatctgttggggaccagtttctggtgcatcagtcagagacgactgaagtcctctgtgagggaataaaaaaagtggtgaatgttctggcctgtgaaaaaatcctcaaaaagtcctatgaggctgcgctgctccctttgtacatggaaggaggttttgtagaggtgattcatgataagaaacagtacccgatttctgagctctgtaaacagttccgtttgcccttcaatgtgaaggtgtctgtcagggatctttccattgaagaggacgtgttggctgccacaccaggactgcagttggaggaggacattacagactcttacctactcataagtgactttgccaaccccacggagtgctgggaaattcctgtgggccgcttgaatatgactgttcagttagttagtaatttctctagggatgcagaaccatttctagtcaggactctggtagaagagatcactgaagagcaatattacatgatgcggagatatgaaagctcagcctcacatcccccacctcgccctccgaaacacccctcagtagaggaaacaaagttaaccctgctaaccttagcagaagaaaggacggtagacctgcccaagtctcccaagcgtcatcacgtagacataaccaagaaacttcacccaaatcaagctggcctggattcaaaagtactgattggtagtcagaatgatttggtggatgaagagaaagaaaggagcaaccgtggggccacagcaatagcagaaacattcaaaaatgaaaaacatcaaaaataacaagatgtgacagaagccacttaggcagcaaacataaatgttgcagtgaaaaaagaagctagccttctagctgaaaaacgagtattccccaatggactccagaagaaacttgattcatcgctgcaaaggaaagaacaaccttaaaacttttaacagataaaacttacagaaacctatgatatagaattcatatagtctattctgttgtgtctaaatctgtaggcattgtgttgttgttctttaggacgtatttatttaacttgcacattttttcagattcttatttctactaccaacaactaagtaattgggaaataattctgtatttcagtttctgagtaaaaccagtctgaaataggataaaagccaccaaatattttcttttttttccagaatttgttttgccattttttagtgctatcatcattcctaacaagactaacttacagaaaaataattatatctgactgatttaaaatgttcaggtttcttatccaaatcccttggaactatggaaaggagtttgatttcacattcacagtgtatttacaaaatacgctgtgtcataaatatgtttgaattccaacagccaaagccattgagagtcataggagttttccataaccttctcttctatgacccaacaacaagctcatgactgaaatttcaccagatttctgagacgatgtcttaatattctatgtgctatgtaccagataattctttagatgaatgtttcttaggattgtaggaaaattatctagttaatcataatatttgatggaaagaaaaagacaataaaattgtaatataataaatttggctgacaagaaaccaaagtgattcttaattagtatacatcagaatgatgctcttatagttgtaccatctataaaaattactttaagggctctcacattttaataatttatcttattatgtattaagtatacaggaacaatattatttttcctttaacaaaatgaagagacaggctatctggttaatgttacataggaatttaatagtaatgcttgaacttcatccatagatcatactctgtacaaaatttgttagctaacatcctatctcataattattttatgttttgtggagaaatttgttgattttgtaccaaagtgtttctgaagacaataaattgtgagtcaactttagaacaaaaaaaattagagttttttcaatgtttatattctgattaagcttactttaccttacattttttctaagtaacaatgaatcctgatttctagtgtcctaaaaattgcttagtgatttgattgtggtaatatcatttcttatctacaatgtctaaagttttatgggacagtttttcttttatttattttgcctgtttgtgcagataagaacagaaacttttctaagacccacatttggttattgaaggccacagcgaatcttaacctaacagccttgacaaactgcaccataggtgtttttagactcatataatttgttatttttcaaacaatagtgaataattaatatttttgtttggaatttgagaacaattaaatttgtacttttagtaactaccattctttgattagaaaattaagagaatgcatatcttactttggttgtaaattatcaagggctttctaatagaaatcatatataacatttctaaatataagtcctttcacatactgtgtttccagttgtcttgatattgaaaagtgtaataaacttcatgctcacctattggagatttgggaaggttgaaaataaacttcctaatttttatttgtatgtgttctcttctatgtttaactctagaataactatcttcctgtaacgattaagttaaaatattctttaactagaattgaaataaattgttcactaaggagggggctgcttgtgctaaaaaa

SEQ ID NO: 31594 - DNA, 631 bp, Homo sapiens
gtctacaaactacccaaggcatagcaatggcattatcactggaagaattcgtccactcccttgacctcaggaccctacccagggttctagaaatccaggcaggcatctatcttgaaggctctatttatgaaatgtttggaaatgaatgctgtttttcaacaggagaagtgattaaaattactggtctcaaagttaagaagatcatagctgaaatttgtgagcagattgaaggttgtgagtctctacagccatttgaactgcctatgaattttccagttcgaaaagatataatccgcatcctccccagtctagatgtcgaagtcaaagacatcactgattcttacgatgctaactggtttcttcagctgttatcaacagaagatctttttgaaatgactagtaaagagttccccatagtgactgaagtcatagaagcacctgaaggaaaccacctgccccaaagcattttacagcctgggaaaaccattgtgatccacaaaaagtaccaggcatcaagaatcttagcttcagaaattagaagcaattttcctaaaagacacttcttgatccccactagctataaaggcaagttcaagcggcgaccgagggagttcccaacggcctatgacct

SEQ ID NO: 31595 - DNA, 3830 bp, Homo sapiens
ttcacagataaagtgttctgcagactcaaggtttatacttacaattacgagatttatatttgcattagtctctttggctggtgggtaggggtgagaggctcttcctggatcccttattttctacaggagaggaggaaaacacctgggatgctccagtgctcttacgcagataatgatcattaacatcagcctctctgatcaaaggctctatttatgaaatgtttggaaatgaatgctgtttttcaacaggagaagtgattaaaattactggtctcaaagttaagaagatcatagctgaaatttgtgagcagattgaaggttgtgagtctctacagccatttgaactgcctatgaattttccaggtctttttaagattgtggctgataaaactccataccttactatggaagaaatcacaaggaccattcatattggaccaagtagactagggcatccttgcttctatcatcagaaggatataaaactagagaacctcatcataaagcagggtgagcaaatcatgctcaactcagttgaagagattgatggagaaataatggtgagctgtgcagtagcaaggaatcatcaaactcactcatttaatttgcctttgtcacaagaaggagaattctacgagtgtgaagatgaacgtatttacactctaaaggagattgttgaatggaagattcctaagaacagaacaagaactgtaaaccttacagatttttcaaataagtgggactcaacgaatccatttcctaaagacttttatggtaccctgattctcaagcctgtttatgaaattcaaggtgtgatgaaatttcgaaaagatataatccgcatcctccccagtctagatgtcgaagtcaaagacatcactgattcttacgatgctaactggtttcttcagctgttatcaacagaagatctttttgaaatgactagtaaagagttccccatagtgactgaagtcatagaagcacctgaaggaaaccacctgccccaaagcattttacagcctgggaaaaccattgtgatccacaaaaagtaccaggcatcaagaatcttagcttcagaaattagaagcaattttcctaaaagacacttcttgatccccactagctataaaggcaagttcaagcggcgaccgagggagttcccaacggcctatgacctagagatcgctaagagtgaaaaggagcctcttcacgtggtggccaccaaagcgtttcattcccctcatgacaagctgtcatccgtatctgttggggaccagtttctggtgcatcagtcagagacgactgaagtcctctgtgagggaataaaaaaagtggtgaatgttctggcctgtgaaaaaatcctcaaaaagtcctatgaggctgcgctgctccctttgtacatggaaggaggttttgtagaggtgattcatgataagaaacagtacccgatttctgagctctgtaaacagttccgtttgcccttcaatgtgaaggtgtctgtcagggatctttccattgaagaggacgtgttggctgccacaccaggactgcagttggaggaggacattacagactcttacctactcataagtgactttgccaaccccacggagtgctgggaaattcctgtgggccgcttgaatatgactgttcagttagttagtaatttctctagggatgcagaaccatttctagtcaggactctggtagaagagatcactgaagagcaatattacatgatgcggagatatgaaagctcagcctcacatcccccacctcgccctccgaaacacccctcagtagaggaaacaaagttaaccctgctaaccttagcagaagaaaggacggtagacctgcccaagtctcccaagcgtcatcacgtagacataaccaagaaacttcacccaaatcaagctggcctggattcaaaagtactgattggtagtcagaatgatttggtggatgaagagaaagaaaggagcaaccgtggggccacagcaatagcagaaacattcaaaaatgaaaaacatcaaaaataacaagatgtgacagaagccacttaggcagcaaacataaatgttgcagtgaaaaaagaagctagccttctagctgaaaaacgagtattccccaatggactccagaagaaacttgattcatcgctgcaaaggaaagaacaaccttaaaacttttaacagataaaacttacagaaacctatgatatagaattcatatagtctattctgttgtgtctaaatctgtaggcattgtgttgttgttctttaggacgtatttatttaacttgcacattttttcagattcttatttctactaccaacaactaagtaattgggaaataattctgtatttcagtttctgagtaaaaccagtctgaaataggataaaagccaccaaatattttcttttttttccagaatttgttttgccattttttagtgctatcatcattcctaacaagactaacttacagaaaaataattatatctgactgatttaaaatgttcaggtttcttatccaaatcccttggaactatggaaaggagtttgatttcacattcacagtgtatttacaaaatacgctgtgtcataaatatgtttgaattccaacagccaaagccattgagagtcataggagttttccataaccttctcttctatgacccaacaacaagctcatgactgaaatttcaccagatttctgagacgatgtcttaatattctatgtgctatgtaccagataattctttagatgaatgtttcttaggattgtaggaaaattatctagttaatcataatatttgatggaaagaaaaagacaataaaattgtaatataataaatttggctgacaagaaaccaaagtgattcttaattagtatacatcagaatgatgctcttatagttgtaccatctataaaaattactttaagggctctcacattttaataatttatcttattatgtattaagtatacaggaacaatattatttttcctttaacaaaatgaagagacaggctatctggttaatgttacataggaatttaatagtaatgcttgaacttcatccatagatcatactctgtacaaaatttgttagctaacatcctatctcataattattttatgttttgtggagaaatttgttgattttgtaccaaagtgtttctgaagacaataaattgtgagtcaactttagaacaaaaaaaattagagttttttcaatgtttatattctgattaagcttactttaccttacattttttctaagtaacaatgaatcctgatttctagtgtcctaaaaattgcttagtgatttgattgtggtaatatcatttcttatctacaatgtctaaagttttatgggacagtttttcttttatttattttgcctgtttgtgcagataagaacagaaacttttctaagacccacatttggttattgaaggccacagcgaatcttaacctaacagccttgacaaactgcaccataggtgtttttagactcatataatttgttatttttcaaacaatagtgaataattaatatttttgtttggaatttgagaacaattaaatttgtacttttagtaactaccattctttgattagaaaattaagagaatgcatatcttactttggttgtaaattatcaagggctttctaatagaaatcatatataacatttctaaatataagtcctttcacatactgtgtttccagttgtcttgatattgaaaagtgtaataaacttcatgctcacctattggagatttgggaaggttgaaaataaacttcctaatttttatttgta

SEQ ID NO: 31596 - DNA, 3983 bp, Homo sapiens
agctactccaccccactctggctgtagtgtgacattcctgcctgcctgaggaagaaatggtgagcaggggctgcaattgcagacaagtgtcacccagaagccacaagtttctgtgagcaccaggtctacaaactacccaaggcatagcaatggcattatcactggaagaattcgtccactcccttgacctcaggaccctacccagggttctagaaatccaggcaggcatctatcttgaaggctctatttatgaaatgtttggaaatgaatgctgtttttcaacaggagaagtgattaaaattactggtctcaaagttaagaagatcatagctgaaatttgtgagcagattgaaggttgtgagtctctacagccatttgaactgcctatgaattttccaggtctttttaagattgtggctgataaaactccataccttactatggaagaaatcacaaggaccattcatattggaccaagtagactagggcatccttgcttctatcatcagaaggatataaaactagagaacctcatcataaagcagggtgagcaaatcatgctcaactcagttgaagagattgatggagaaataatggtgagctgtgcagtagcaaggaatcatcaaactcactcatttaatttgcctttgtcacaagaaggagaattctacgagtgtgaagatgaacgtatttacactctaaaggagattgttgaatggaagattcctaagaacagaacaagaactgtaaaccttacagatttttcaaataagtgggactcaacgaatccatttcctaaagacttttatggtaccctgattctcaagcctgtttatgaaattcaaggtgtgatgaaatttcgaaaagatataatccgcatcctccccagtctagatgtcgaagtcaaagacatcactgattcttacgatgctaactggtttcttcagctgttatcaacagaagatctttttgaaatgactagtaaagagttccccatagtgactgaagtcatagaagcacctgaaggaaaccacctgccccaaagcattttacagcctgggaaaaccattgtgatccacaaaaagtaccaggcatcaagaatcttagcttcagaaattagaagcaattttcctaaaagacacttcttgatccccactagctataaaggcaagttcaagcggcgaccgagggagttcccaacggcctatgacctagagatcgctaagagtgaaaaggagcctcttcacgtggtggccaccaaagcgtttcattcccctcatgacaagctgtcatccgtatctgttggggaccagtttctggtgcatcagtcagagacgactgaagtcctctgtgagggaataaaaaaagtggtgaatgttctggcctgtgaaaaaatcctcaaaaagtcctatgaggctgcgctgctccctttgtacatggaaggaggttttgtagaggtgattcatgataagaaacagtacccgatttctgagctctgtaaacagttccgtttgcccttcaatgtgaaggtgtctgtcagggatctttccattgaagaggacgtgttggctgccacaccaggactgcagttggaggaggacattacagactcttacctactcataagtgactttgccaaccccacggagtgctgggaaattcctgtgggccgcttgaatatgactgttcagttagttagtaatttctctagggatgcagaaccatttctagtcaggactctggtagaagagatcactgaagagcaatattacatgatgcggagatatgaaagctcagcctcacatcccccacctcgccctccgaaacacccctcagtagaggaaacaaagttaaccctgctaaccttagcagaagaaaggacggtagacctgcccaagtctcccaaggctggagtgcaatggcgtgatcttggctcgctgcaacctctgcctcccgggttcaagcaattctctgcctcagcctcccacgtagctgggattacaggcaccccccaccacgtccagcgtcatcacgtagacataaccaagaaacttcacccaaatcaagctggcctggattcaaaagtactgattggtagtcagaatgatttggtggatgaagagaaagaaaggagcaaccgtggggccacagcaatagcagaaacattcaaaaatgaaaaacatcaaaaataacaagatgtgacagaagccacttaggcagcaaacataaatgttgcagtgaaaaaagaagctagccttctagctgaaaaacgagtattccccaatggactccagaagaaacttgattcatcgctgcaaaggaaagaacaaccttaaaacttttaacagataaaacttacagaaacctatgatatagaattcatatagtctattctgttgtgtctaaatctgtaggcattgtgttgttgttctttaggacgtatttatttaacttgcacattttttcagattcttatttctactaccaacaactaagtaattgggaaataattctgtatttcagtttctgagtaaaaccagtctgaaataggataaaagccaccaaatattttcttttttttccagaatttgttttgccattttttagtgctatcatcattcctaacaagactaacttacagaaaaataattatatctgactgatttaaaatgttcaggtttcttatccaaatcccttggaactatggaaaggagtttgatttcacattcacagtgtatttacaaaatacgctgtgtcataaatatgtttgaattccaacagccaaagccattgagagtcataggagttttccataaccttctcttctatgacccaacaacaagctcatgactgaaatttcaccagatttctgagacgatgtcttaatattctatgtgctatgtaccagataattctttagatgaatgtttcttaggattgtaggaaaattatctagttaatcataatatttgatggaaagaaaaagacaataaaattgtaatataataaatttggctgacaagaaaccaaagtgattcttaattagtatacatcagaatgatgctcttatagttgtaccatctataaaaattactttaagggctctcacattttaataatttatcttattatgtattaagtatacaggaacaatattatttttcctttaacaaaatgaagagacaggctatctggttaatgttacataggaatttaatagtaatgcttgaacttcatccatagatcatactctgtacaaaatttgttagctaacatcctatctcataattattttatgttttgtggagaaatttgttgattttgtaccaaagtgtttctgaagacaataaattgtgagtcaactttagaacaaaaaaaattagagttttttcaatgtttatattctgattaagcttactttaccttacattttttctaagtaacaatgaatcctgatttctagtgtcctaaaaattgcttagtgatttgattgtggtaatatcatttcttatctacaatgtctaaagttttatgggacagtttttcttttatttattttgcctgtttgtgcagataagaacagaaacttttctaagacccacatttggttattgaaggccacagcgaatcttaacctaacagccttgacaaactgcaccataggtgtttttagactcatataatttgttatttttcaaacaatagtgaataattaatatttttgtttggaatttgagaacaattaaatttgtacttttagtaactaccattctttgattagaaaattaagagaatgcatatcttactttggttgtaaattatcaagggctttctaatagaaatcatatataacatttctaaatataagtcctttcacatactgtgtttccagttgtcttgatattgaaaagtgtaataaacttcatgctcacctattggagatttgggaaggttgaaaataaacttcctaatttttatttgta

SEQ ID NO: 31597 - DNA, 4131 bp, Homo sapiens
ggtgcgcgccgcggcttgggggagagttgagcgcttttcccccctcttttttttttttttcctcttcttcttaaacaaaccacaaacggatgtgagggaaggaaggtgtttcttttactcctgagcccagacacctcactctgttccgtctaagcttgttttgctgaacacttttttttaaaaaaggaaaaagaaaaggagttgcttgatgtgagagtgaaatggacgtaagattttatccacctccagcccagcccgccgctgcgcccgacgctccctgtctgggaccttctccctgcctggacccctactattgcaacaagtttgacggtgagaacatgtatatgagcatgacagagccgagccaggactatgtgccagccagccagtcctaccctggtccaagcctggaaagtgaagacttcaacattccaccaattactcctccttccctcccagaccactcgctggtgcacctgaatgaagttgagtctggttaccattctctgtgtcaccccatgaaccataatggcctgctaccatttcatccacaaaacatggacctccctgaaatcacagtctccaatatgctgggccaggatggaacactgctttctaattccatttctgtgatgccagatatacgaaacccagaaggaactcagtacagttcccatcctcagatggcagccatgagaccaaggggccagcctgcagacatcaggcagcagccaggaatgatgccacatggccagctgactaccattaaccagtcacagctaagtgctcaacttggtttgaatatgggaggaagcaatgttccccacaactcaccatctccacctggaagcaagtctgcaactccttcaccatccagttcagtgcatgaagatgaaggcgatgatacctctaagatcaatggtggagagaagcggcctgcctctgatatggggaaaaaaccaaaaactcccaaaaagaagaagaagaaggatcccaatgagccccagaagcctgtgtctgcctatgcgttattctttcgtgatactcaggccgccatcaagggccaaaatccaaacgctacctttggcgaagtctctaaaattgtggcttcaatgtgggacggtttaggagaagagcaaaaacaggtctataaaaagaaaaccgaggctgcgaagaaggagtacctgaagcaactcgcagcatacagagccagccttgtatccaagagctacagtgaacctgttgacgtgaagacatctcaacctcctcagctgatcaattcgaagccgtcggtgttccatgggcccagccaggcccactcggccctgtacctaagttcccactatcaccaacaaccgggaatgaatcctcacctaactgccatgcatcctagtctccccaggaacatagcccccaagccgaataaccaaatgccagtgactgtctctatagcaaacatggctgtgtcccctcctcctcccctccagatcagcccgcctcttcaccagcatctcaacatgcagcagcaccagccgctcaccatgcagcagccccttgggaaccagctccccatgcaggtccagtctgccttacactcacccaccatgcagcaaggatttactcttcaacccgactatcagactattatcaatcctacatctacagctgcacaagttgtcacccaggcaatggagtatgtgcgttcggggtgcagaaatcctcccccacaaccggtggactggaataacgactactgcagtagtgggggcatgcagagggacaaagcactgtaccttacttgagaatctgaacacctcttctttccactgaggaattcagggaagtgttttcaccatggattgctttgtacagtcaaggcagttctccattttattagaaaatacaagttgctaagcacttaggaccatttgagcttgtgggtcacccactctggaagaaatagtcatgcttctttattatttttttaatcctttatggacattgtttttcttcttccctgaaggaaatttggaccattcagattttatgttggttttttgctgtgaagtgctgcgctctagtaactgccttagcaactgtagatgtctcggataaaagtcctggattttccattggttttcataatgggtgtttatatgaaactactaaagactttttaaatggcttgatgtagcagtcatagcaagtttgtaaatagcatctatgttacactctcctagagtataaaatgtgaatgtttttgtagctaaattgtaattgaaactggctcattccagtttattgatttcacaataggggttaaattggcaaacattcatatttttacttcatttttaaaacaactgactgatagttctatattttcaaaatatttgaaaataaaaagtattcccaagtgattttaatttaaaaacaaattggctttgtctcattgatcagacaaaaagaaactagtattaagggaagcgcaaacacatttattttgtactgcagaaaaattgcttttttgtatcactttttgtgtaatggttagtaaatgtcatttaagtccttttatgtataaaactgccaaatgcttacctggtattttattagatgcagaaacagattggaaacagctaaattacaacttttacatatggctctgtcttattgtttcttcatactgtgtctgtatttaatctttttttatggaacctgttgcgcctatttatgaaataataaatataggtgtttgtaagtaaatttgttagtatttgaaagaggtttctttgatgttttaacttttgctggcaaaaaaaaattcacgcttggtgtgaatactttattatttagtttttacagtaacatgaataaagccaaacctgcttttcatttagcagcaaattaaagtaaccagtccttatttctgcatttctttggttgatgcaaacaaaaaactattatatttaagaactttatttcttcatacgacataacagaattgccctccaagtcacacaagctccaagactaaacaaacagacaggtcctctgtcttaaaaaggttacttcttggttctcagctggttctagtcaattctgaaccaccaccccccgccccccgcaaaaaagtaaaagtcaaaccaaacttcctcaagctgcatgcttttcacaaaatccagaaagcatttaagaattgaactaggggctggaagaagtgaaagggaagcatctaaaaatgaaaggtgagtaaccagatagcaaaagaaaagggaaagccatccaaatttgaaagctgttgatagaaattgagattcttgctgtcttttgtgcctctacaagctactactcattccagaattcctgggtcttccaagaggattcttaaggtaccagagatttgctagggaaccaaaagtgcttgagaatctgcctgagggcttgcatagctttcacattaaaaaaagaaaaagctagcagatttactcctttttaggggatcatatcaagaaagttagtctggttggaaaccaagagaatggctgatgtctctttcttggaatatgtgaaataaatttagcagtttaactaaatacaaatatatgcattgtgtaatccactcagaattaaacagacaaaaggtatgcttgctttggaatgattttaggcattgtacaaccttgaatcacttgagcatgtaataactaataaataatgcagatccatgtgattattaaaatgactgtagctgagagctctaattttcctgtcttgaaactgtataagaactcatgtgattaagttcacagtttattgtttgtctgtttagtattttagaaatataccagcactactaattaactaatgtcttttatttattatattatgataaagtaaaaatttcacttgcattaagtctaaactgagaaggtaattactgggaggagaatgagcagctttgactttgacaggcggtttgtgcaggaaagcacagtgccgtgttgtttacagcttttctagagcagctgtgcgaccagggtagagagtgttgaaattcaataccaaatacagtaaaaacaaatgtaaataaaagaaaacacatcatcaataaaactgttattatgcgtg

SEQ ID NO: 31598 - DNA, 4107 bp, Homo sapiens
ggtgcgcgccgcggcttgggggagagttgagcgcttttcccccctcttttttttttttttcctcttcttcttaaacaaaccacaaacggatgtgagggaaggaaggtgtttcttttactcctgagcccagacacctcactctgttccgtctaagcttgttttgctgaacacttttttttaaaaaaggaaaaagaaaaggagttgcttgatgtgagagtgaaatggacgtaagattttatccacctccagcccagcccgccgctgcgcccgacgctccctgtctgggaccttctccctgcctggacccctactattgcaacaagtttgacggtgagaacatgtatatgagcatgacagagccgagccaggactatgtgccagccagccagtcctaccctggtccaagcctggaaagtgaagacttcaacattccaccaattactcctccttccctcccagaccactcgctggtgcacctgaatgaagttgagtctggttaccattctctgtgtcaccccatgaaccataatggcctgctaccatttcatccacaaaacatggacctccctgaaatcacagtctccaatatgctgggccaggatggaacactgctttctaattccatttctgtgatgccagatatacgaaacccagaaggaactcagtacagttcccatcctcagatggcagccatgagaccaaggggccagcctgcagacatcaggcagcagccaggaatgatgccacatggccagctgactaccattaaccagtcacagctaagtgctcaacttggtttgaatatgggaggaagcaatgttccccacaactcaccatctccacctggaagcaagtctgcaactccttcaccatccagttcagtgcatgaagatgaaggcgatgatacctctaagatcaatggtggagagaagcggcctgcctctgatatggggaaaaaaccaaaaactcccaaaaagaagaagaagaaggatcccaatgagccccagaagcctgtgtctgcctatgcgttattctttcgtgatactcaggccgccatcaagggccaaaatccaaacgctacctttggcgaagtctctaaaattgtggcttcaatgtgggacggtttaggagaagagcaaaaacaggtctataaaaagaaaaccgaggctgcgaagaaggagtacctgaagcaactcgcagcatacagagccagccttgtatccaagagctacagtgaacctgttgacgtgaagacatctcaacctcctcagctgatcaattcgaagccgtcggtgttccatgggcccagccaggcccactatcaccaacaaccgggaatgaatcctcacctaactgccatgcatcctagtctccccaggaacatagcccccaagccgaataaccaaatgccagtgactgtctctatagcaaacatggctgtgtcccctcctcctcccctccagatcagcccgcctcttcaccagcatctcaacatgcagcagcaccagccgctcaccatgcagcagccccttgggaaccagctccccatgcaggtccagtctgccttacactcacccaccatgcagcaaggatttactcttcaacccgactatcagactattatcaatcctacatctacagctgcacaagttgtcacccaggcaatggagtatgtgcgttcggggtgcagaaatcctcccccacaaccggtggactggaataacgactactgcagtagtgggggcatgcagagggacaaagcactgtaccttacttgagaatctgaacacctcttctttccactgaggaattcagggaagtgttttcaccatggattgctttgtacagtcaaggcagttctccattttattagaaaatacaagttgctaagcacttaggaccatttgagcttgtgggtcacccactctggaagaaatagtcatgcttctttattatttttttaatcctttatggacattgtttttcttcttccctgaaggaaatttggaccattcagattttatgttggttttttgctgtgaagtgctgcgctctagtaactgccttagcaactgtagatgtctcggataaaagtcctggattttccattggttttcataatgggtgtttatatgaaactactaaagactttttaaatggcttgatgtagcagtcatagcaagtttgtaaatagcatctatgttacactctcctagagtataaaatgtgaatgtttttgtagctaaattgtaattgaaactggctcattccagtttattgatttcacaataggggttaaattggcaaacattcatatttttacttcatttttaaaacaactgactgatagttctatattttcaaaatatttgaaaataaaaagtattcccaagtgattttaatttaaaaacaaattggctttgtctcattgatcagacaaaaagaaactagtattaagggaagcgcaaacacatttattttgtactgcagaaaaattgcttttttgtatcactttttgtgtaatggttagtaaatgtcatttaagtccttttatgtataaaactgccaaatgcttacctggtattttattagatgcagaaacagattggaaacagctaaattacaacttttacatatggctctgtcttattgtttcttcatactgtgtctgtatttaatctttttttatggaacctgttgcgcctatttatgaaataataaatataggtgtttgtaagtaaatttgttagtatttgaaagaggtttctttgatgttttaacttttgctggcaaaaaaaaattcacgcttggtgtgaatactttattatttagtttttacagtaacatgaataaagccaaacctgcttttcatttagcagcaaattaaagtaaccagtccttatttctgcatttctttggttgatgcaaacaaaaaactattatatttaagaactttatttcttcatacgacataacagaattgccctccaagtcacacaagctccaagactaaacaaacagacaggtcctctgtcttaaaaaggttacttcttggttctcagctggttctagtcaattctgaaccaccaccccccgccccccgcaaaaaagtaaaagtcaaaccaaacttcctcaagctgcatgcttttcacaaaatccagaaagcatttaagaattgaactaggggctggaagaagtgaaagggaagcatctaaaaatgaaaggtgagtaaccagatagcaaaagaaaagggaaagccatccaaatttgaaagctgttgatagaaattgagattcttgctgtcttttgtgcctctacaagctactactcattccagaattcctgggtcttccaagaggattcttaaggtaccagagatttgctagggaaccaaaagtgcttgagaatctgcctgagggcttgcatagctttcacattaaaaaaagaaaaagctagcagatttactcctttttaggggatcatatcaagaaagttagtctggttggaaaccaagagaatggctgatgtctctttcttggaatatgtgaaataaatttagcagtttaactaaatacaaatatatgcattgtgtaatccactcagaattaaacagacaaaaggtatgcttgctttggaatgattttaggcattgtacaaccttgaatcacttgagcatgtaataactaataaataatgcagatccatgtgattattaaaatgactgtagctgagagctctaattttcctgtcttgaaactgtataagaactcatgtgattaagttcacagtttattgtttgtctgtttagtattttagaaatataccagcactactaattaactaatgtcttttatttattatattatgataaagtaaaaatttcacttgcattaagtctaaactgagaaggtaattactgggaggagaatgagcagctttgactttgacaggcggtttgtgcaggaaagcacagtgccgtgttgtttacagcttttctagagcagctgtgcgaccagggtagagagtgttgaaattcaataccaaatacagtaaaaacaaatgtaaataaaagaaaacacatcatcaataaaactgttattatgcgtg

SEQ ID NO: 31599 - DNA, 820 bp, Homo sapiens
ttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcaggtatctttagttttattaccaccgtgtacaggtataaataacctcctgacaacactaatccatgttttagcctttaatggttgacacccagattccagcacgctcaataaacttaattctgttgttaaatgatactaaaaa

SEQ ID NO: 31600 - DNA, 3615 bp, Homo sapiens
gggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaaggaaagaagaaagaacacaagaaagtgaagtccactagggatattgttcctttttctgaacttggaactactccctctggtggtggattttttcagggtatttcttttcctgaaatctccacccgtcctcctttgggcagtaccgaactacaggcagctaagaaagtacatacttctaagggagacctacctagggagcctcttgttgccacaaacttgcctggcaggggacagttgcagaagttagcctctgaaaggaatttgtttatttcatgcaagtctagccatgataggtgtttagagaaaagttcttcgtcatcttctcagcctgaacacagtgccatgttggtctctactgcagcttctccttcactgattaaagaaaccaccactggttactataaagacatagtagaaaatatttgcggtagagagaaaagtggaattcaaccattatgtcctgagaggtcccatatttcagatcaatcgcctctctccagtaaaaggaaagcactagaagagtctgagagctcacaactaatttctccgccacttgcccaggcaatcagagattatgtcaattctctgttggtccagggtggggtaggtagtttgcctggaacttctaactctatgcccccactggatgtagaaaacatacagaagagaattgatcagtctaagtttcaagaaactgaattcctgtctcctccaagaaaagtccctagactgagtgagaagtcagtggaggaaagggattcaggttcctttgtggcatttcagaacatacctggatccgaactgatgtcttcttttgccaaaactgttgtctctcattcactcactaccttaggtctagaagtggctaagcaatcacagcatgataaaatagatgcctcagaactatcttttcccttccatgaatctattttaaaagtaattgaagaagaatggcagcaagttgacaggcagctgccttcactggcatgcaaatatccagtttcttccagggaggcaacacagatattatcagttccaaaagtagatgatgaaatcctagggtttatttctgaagccactccactaggaggtattcaagcagcctccactgagtcttgcaatcagcagttggacttagcactctgtagagcatatgaagctgcagcatcagcattgcagattgcaactcacactgcctttgtagctaaggctatgcaggcagacattagtcaagctgcacagattcttagctcagatcctagtcgtacccaccaagcgcttgggattctgagcaaaacatatgatgcagcctcatatatttgtgaagctgcatttgatgaagtgaagatggctgcccataccatgggaaatgccactgtaggtcgtcgatacctctggctgaaggattgcaaaattaatttagcttctaagaataagctggcttccactccctttaaaggtggaacattatttggaggagaagtatgcaaagtaattaaaaagcgtggaaataaacactagtaaaattaaggacaaaaagacatctatcttatctttcaggtactttatgccaacattttcttttctgttaaggttgttttagtttccagatagggctaattacaaaatgttaagcttctacccatcaaattacagtataaaagtaattgcctgtgtagaactacttgtcttttctaaagatttgcgtagataggaagcctggtacaaacaatttaacgctttctagatcacatattagtctctaagttgttttctgtttcctgctttacttatgtttttacaattctccaaaactaagaaaattctaattaggatataaggagtatttactgttcaatagaataatatgcatcctcctttatacctaggacagaattaaacatttgttacacattcagaacagtgatgttgttctttttgatacttttatctcagtatcttttcacgttccataacttgtccatatttttgctcatattttcttacttttctttgttatttattcatgtctgcaacatcaatcatagtagtctagatcaatgcaactcaaagcaccagtctacaaactgttacttatccacaggcaagataagcatgcacaagaatttaaatctagagatactttttaggtcaatgacaggatttgattttttagcaaaattttattaatagctaaagcaatgtattgatttacactctgatgcaagtaatttatctcttcattgactggtagcaaccaattcatggaccagtaccatggaccacactttgagaaacacttctttggataataatagatatcctgggatagtgcatgttcaccatctattttgtcagataatggggccttttaaaaaataatactttgctttcatgatatattgtattttgtggaaagttaagtttagcaatatagactctaaaagcaaattaaatttttttaagccataagaaattatactatatcccagtatctgtatgtctgtataaagcagtgtattatcatgttttcatttctgtgattgtaagttaagagtcttaactgcagaggtattgtggaaagtagtagccttaagcataataaaatatggtctcttgggtactccctctggccattaccacattcttagattatatgtgtccatctttgcagctttctgagagtaattttatttgttgtcttctgaaatgtacatgtatacatgtacctactgagtgctatgtgatttttaaaaatgtattactgtagaatgcttctgcaaattcaataaagttgttaaatttgaacagtg

SEQ ID NO: 31601 - DNA, 2465 bp, Homo sapiens
gtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcaggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaa

SEQ ID NO: 31602 - DNA, 2374 bp, Homo sapiens
ggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcaggtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaagtacaaaaagggccaggcgcggtggcttacgcctgtaatcccagcactttgggaggccagggcgggtggatcacgaggtcaagagatcaagaccatcctggccaacatggtgaaaccccgtctctacta

SEQ ID NO: 31603 - DNA, 4242 bp, Homo sapiens
cgcgagccgtctcgccaatcaccgccgcgcttcctcccgtcgcccgccaatggcggcgcgcgttcttggggcgtgggcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcagagctattctcaagctggaataactgagactgaatggacaagtggatcttcaaaaggcggacctctgcaggcattaactagggaatctacaagagggtcaagaagaactccaaggaaaagggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaagtacaaaaagggccaggcgcggtggcttacgcctgtaatcccagcactttgggaggccagggcgggtggatcacgaggtcaagagatcaagaccatcctggccaacatggtgaaaccccgtctctactaaaaatacaaaaaaattagctgggcgtgatgatgtgcgcctgtagtcctgtctactagggagactgaggcaggagaatcgtttgaacccaggaggcagaggttgcagtgagcagagattacgtcactgcactgtagcctggcgacagagcaagactccatctcaaaaaaaataaaaaagtacaaaaagtacttgcttttatattacatcataagcagtagttaataaagttgtatactcttaagaggtgggcattatgattattttttatttttttattttttatgagatggagtctcactcttgtcacccagactgtagtgcagtggcacgatctgggctcgatgcaacctctgcctcccaggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctctagttttgtcgttgcaataaatggttttcagatagcacaaactgtgatttctggataacatttcttatg

SEQ ID NO: 31604 - DNA, 495 bp, Homo sapiens
ggcaagaccggcttcggggcgcgcggcggccgctttgtgtgcggggctgcattgtgacgcgggcgatgaagccgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaa

SEQ ID NO: 31605 - DNA, 767 bp, Homo sapiens
gtgaaggcattccctaaatccgagcccgagtggttctccccgggaaggctactttggggagctggggggatgcgaaacaccctagatactggataatggggtggggaaatcgatgatttaagaacaaaaccgaaaaactggcgttttgccgtgccgctcggaggggacattaaaaaatttcttagtgtttgcccgcaaagcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattattggaatgcacaatttttttaatatgcaaataaaaagtttaaaaactta

SEQ ID NO: 31606 - DNA, 1702 bp, Homo sapiens
aactcggtggtggccactgcgcagaccagacttcgctcgtactcgtgcgcctcgcttcggtgagccccagggcccctgcctccttcctcctgccgtcctgcctccgtccccgccctttcatcatccgcgtccctgtgaaggcattccctaaatccgagcccgagtggttctccccgggaaggctactttggggagctggggggatgcgaaacaccctagatactggataatggggtggggaaatcgatgatttaagaacaaaaccgaaaaactggcgttttgccgtgccgctcggaggggacattaaaaaatttcttagtgtttgcccgcaaaggtattgtgcgttgccttggaggctgagatatgggggaatagacaagtcctttgttctgaggttcatcttccgagccccgagcctcctcccagcctcggacggctgcgcgggctgcatctgtgcagcctggcggcggcggggctgtgctatgacatctttacagtccttcttgcagagacatgtgtgccagggatgccgaattgccgggagagcaggcaagaccggcttcggggcgcgcggcggccgctttgtgtgcggggctgcattgtgacgcgggcgatgaagccggtagggcggtggtcggaagctccagccgcggccgccgcctttgtgagaggactagaaagccggatccggcccgcatccttgcggagaggccgcggctaggaaatggaaacgcttttcctacctgggctccattttaggaattcttgccgatttttcccacttgaatttggaagtggctttcctcttctttccttgtcctagccagcctttaattttaaacgctgtaattaacaattcgcagtggtcaatttcctttattctgcaagattcggctttgagaggcatccgccctctttggtccacagcgttttgaaatatggggaggaggggcgcggggggtgtcgcctctttttctgtagaaagaggaagctcgtgagcgcggaacggcagcagtaggagagcgagaagggtttttttcaggctgcgggtcggagggcagaagtgcagttcccagcccagagacagcggggcgggtggctcttcctcacgctcgctcttggcttgctccctgcagcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattattggaatgcacaatttttttaatatgcaaataaaaagtttaaaaactt

SEQ ID NO: 31607 - DNA, 628 bp, Homo sapiens
acaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattattggaatgcacaatttttttaatatgcaaataaaaagtttaaaaactta

SEQ ID NO: 31608 - DNA, 1669 bp, Homo sapiens
tgggaacagacagatcctttgttctgaggctcactcatctcccgagccccgagccgtctcccagcctcagacggctctgcgggctgcatctgtgcagcctggcagcggcggcgctgcgctgtgacattttcacagcccttcttgcagaggcatgtgtgctagggatgccgaaatgccgagagcgccggcaggactagcttccgggccgcgctttgtgtgctgggctgcagtgtggcgcgggcgaggaagctggtagggcggttgtcgcaagctccagctgcagcctccgcctacgtgagaagactagaaagcgggcgcaggaccaggcctgcgttgtttgcagagaggccgtggctacaaaatggaagtgcttttgcgacctgggctccattttaggaattcttgcccgattttaaccacttgaacgcggaagtggctttcctattctcttccaagccagcctttaattttaaacgctgtaattaacagttcacaggggtcaaattcctttattccggaacattccactttgagagggatctgtcctctttggtcccctgcgttttcaaatatttgaggaaaggtgtcgcctctttttctgtggaaagaggaagctcatgagcgcgaaacagcaggggacggagggcgagaagggctttctcaggttgcgggtcggagggcagaagcacagttcccagtacagagacccggacaggtggctgtttctcacgctcactttggattgctccctacggcttcctccgcagccatgtctgacaaacctggtatggctgagatcgagaaattcgataagtcgaaactgaagaagacagaaacgcaagagaagaatccattgtcttccaaagaaactatcgaacaggagaggcaagcaggcgaatcttaaacaggcatgtgccaccaatatctactgtacattctacaagcattgctttcttattttacttcttttacttgtttaacttggttagatgcaaacacgttggatgagtttgaaaggactatgctgcccttttgacatcaaagacctgctgacaatggaggccacgcctgcttctcccatcgcctgtctggctggcagggaaggaaaatagcttgaatgttggtgaaagacttagcggagtgggagggcagtgaaatctagagtaaaaccaagttgggccaagtgtcctgcagaatctaaaatgaagtttaatcagcgtgccatttttgttgttgtttgaaagattttaatttttggaatgcacagtttttatttaaaaaagacatttttaaaccactgcttgtgagattgcttgttgattggaaagagtgttttattcaccatttaaacgtttgcaaagtggcgtgccccttggcctcacaggcaaagaataacttaaaagctgacgatttgaataaattatgttacagtatgaaatatgttttacctggatatgtaaaataccttctttattctagctaattgggagatgattttttttggctaattgagattacctttagattatgttttcaaaactggcttatactgtaatctacaactaataagcactaatttagagttcagctatattgttgcatgtagtgagaagggacttaattacaaacttaagacgtaagtgtgcaataaagtaagctaagaagaaaa

SEQ ID NO: 31609 - DNA, 8450 bp, Homo sapiens
cagtggtttctcctccttcctcccaggaagggccaggaaaatggccctggtcctggagatcttcaccctgctggcctccatctgctgggtgtcggccaatatcttcgagtaccaggtggatgcccagccccttcgtccctgtgagctgcagagggaaacggcctttctgaagcaagcagactacgtgccccagtgtgcagaggatggcagcttccagactgtccagtgccagaacgacggccgctcctgctggtgtgtgggtgccaacggcagtgaagtgctgggcagcaggcagccaggacggcctgtggcttgtctgtcattttgtcagctacagaaacagcagatcttactgagtggctacattaacagcacagacacctcctacctccctcagtgtcaggattcaggggactacgcgcctgttcagtgtgatgtgcagcaggtccagtgctggtgtgtggacgcagaggggatggaggtgtatgggacccgccagctggggaggccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttatgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtg

SEQ ID NO: 31610 - DNA, 8282 bp, Homo sapiens
gcagtggtttctcctccttcctcccaggaagggccaggaaaatggccctggtcctggagatcttcaccctgctggcctccatctgctgggtgtcggccaatatcttcgagtaccaggtggatgcccagccccttcgtccctgtgagctgcagagggaaacggcctttctgaagcaagcagactacgtgccccagtgtgcagaggatggcagcttccagactgtccagtgccagaacgacggccgctcctgctggtgtgtgggtgccaacggcagtgaagtgctgggcagcaggcagccaggacggcctgtggcttgtctgtcattttgtcagctacagaaacagcagatcttactgagtggctacattaacagcacagacacctcctacctccctcagtgtcaggattcaggggactacgcgcctgttcagtgtgatgtgcagcaggtccagtgctggtgtgtggacgcagaggggatggaggtgtatgggacccgccagctggggaggccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcacttgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttatgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 31611 - DNA, 2664 bp, Homo sapiens
atggccctggtcctggagatcttcaccctgctggcctccatctgctgggtgtcggccaatatcttcgagtaccaggtggatgcccagccccttcgtccctgtgagctgcagagggaaacggcctttctgaagcaagcagactacgtgccccagtgtgcagaggatggcagcttccagactgtccagtgccagaacgacggccgctcctgctggtgtgtgggtgccaacggcagtgaagtgctgggcagcaggcagccaggacggcctgtggcttgtctgtcattttgtcagctacagaaacagcagatcttactgagtggctacattaacagcacagacacctcctacctccctcagtgtcaggattcaggggactacgcgcctgttcagtgtgatgtgcagcaggtccagtgctggtgtgtggacgcagaggggatggaggtgtatgggacccgccagctggggaggccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtga

SEQ ID NO: 31612 - DNA, 3706 bp, Homo sapiens
ccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttatgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccga

SEQ ID NO: 31613 - DNA, 8149 bp, Homo sapiens
gcagtggtttctcctccttcctcccaggaagggccaggaaaatggccctggtcctggagatcttcaccctgctggcctccatctgctgggtgtcggccaatatcttcgagtaccaggtggatgcccagccccttcgtccctgtgagctgcagagggaaacggcctttctgaagcaagcagactacgtgccccagtgtgcagaggatggcagcttccagactgtccagtgccagaacgacggccgctcctgctggtgtgtgggtgccaacggcagtgaagtgctgggcagcaggcagccaggacggcctgtggcttgtctgtcattttgtcagctacagaaacagcagatcttactgagtggctacattaacagcacagacacctcctacctccctcagtgtcaggattcaggggactacgcgcctgttcagtgtgatgtgcagcaggtccagtgctggtgtgtggacgcagaggggatggaggtgtatgggacccgccagctggggaggccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttatgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 31614 - DNA, 2421 bp, Homo sapiens
gaggcggcctgcagggagcagccgcgagccggccgggcgcgccgagcccgagccccagccggagcggggcgggggagggaggagccagagcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctgaagccccccagaaggccgatggggaaggagaaggagtgccataccttctcccaggcctctgccccaagagcaggaggtgcctgaaagctgggagcgtgggctcagcagggctggtcacctcccatcccgtaagaccaccttcccttcctcagcaggccaaacatggccagactcccttgctttttgctgtgtagttccctctgcctgggatgcccttccccctttctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattgaa

SEQ ID NO: 31615 - DNA, 9996 bp, Homo sapiens
gatccgctgccgctttccgagcgagtgtcatggcggccggcgtcgagttggcaggagtaacccacggaactgaggaaagtcattagagctgagaaagaagtggcccaatctggacggtgggaattcgtgggaatgagcagaaggccctccgtaggtgactgtgtcactagaggcgggcccctggtaaaattccaggccaggcctctgcgtttctaggcagaacctggagtcggccttgcctgagaacccagctttgtgttatcgtatcctgtctcgcgaaggcaggcgttcaaggatatttggtcggatcgcccggcggcgctaaacgttttcttttttccgagcggaccgggtcgttctctaaactcgccgcgatgtcgtcctggcttgggggcctcggctccggattgggccagtctctgggtcaagtcgggggcagcctggcttccctcactggccagatatcaaactttacaaaggatatgctgatggagggcacggaggaagtggaagcagaattacctgattctaggacaaaggaaattgaagccattcatgcaatcttgagatcagagaatgaaaggcttaagaaactttgtactgatctagaagagaaacatgaagcatcagagattcaaataaagcagcaatctacaagttaccgaaatcaacttcaacaaaaagaggtagaaatcagccatcttaaagccagacagattgcactccaggatcagttgctgaaactgcagtcagctgctcagtcagtaccttcaggagctggtgtaccagcaaccactgcatcatcttcattcgcttatgggattagtcatcatccttcagctttccatgacgatgacatggactttggtgatataatttcatcccaacaagaaataaaccgactctcaaatgaagtttcaagacttgagtctgaagttggccattggaggcatattgctcagacttccaaagcacaaggaacagataactctgatcaaagtgaaatatgtaaactacaaaatatcattaaggaactaaaacagaaccgaagtcaggaaattgatgaccatcaacatgaaatgtcagtactgcagaatgcacaccaacagaaattgacagaaataagtcgacgacatcgagaagaattaagtgactatgaagaacgaattgaagaacttgaaaatctgttacaacaaggtggctctggagttatagaaactgatctctctaaaatctatgagatgcaaaaaactattcaagttctacaaatagaaaaagtggagtctaccaaaaaaatggaacaacttgaggataaaataaaagatataaataaaaaattatcttctgcagaaaatgacagagatattttgaggagagaacaagaacagctaaatgtggaaaagagacaaataatggaagaatgtgaaaacttgaaattggaatgtagtaaattgcagccttctgctgtgaagcaaagtgatactatgacagaaaaggaaagaattcttgcccagagtgcatcagtggaagaagtgttcagactacaacaagcactgtctgatgccgaaaatgaaataatgagattgagtagtttaaaccaggataacagtcttgctgaagacaatctgaaacttaaaatgcgtatcgaagttttagaaaaagagaagtcattactgagtcaagaaaaggaagaacttcagatgtcacttttaaaattgaacaatgaatatgaagtaattaaaagtacagctacaagagacataagtttggattcagaattacatgacttaagacttaatttggaggcaaaggaacaagaactcaatcagagtattagtgaaaaggaaacactgatagctgagatagaagaattggacagacagaatcaagaagctacaaagcacatgattttgataaaagatcagctatcaaaacaacaaaatgaaggagatagcatcatcagtaaactgaaacaagatctaaatgatgaaaaaaagagagttcatcaacttgaagatgataaaatggacattactaaagagttagatgtacagaaagaaaagctaattcaaagtgaagtggccctaaatgatttacatttaaccaagcagaaacttgaggacaaagtagaaaatttagtagatcagctaaataaatcacaagaaagtaatgtaagcatccagaaggagaatttagaacttaaggagcatattagacaaaatgaggaggagctttctagaataaggaatgagttaatgcagtctctaaatcaagactctaatagtaattttaaggataccttacttaaagaaagagaagctgaagttagaaacttaaagcaaaatctttcagaattagaacagctcaatgaaaatttaaagaaagttgcttttgatgtcaaaatggaaaatgaaaagttagttttagcatgtgaagatgtgaggcatcagttagaagaatgtcttgctggtaacaatcagctttctctggaaaaaaacactattgtggagactctaaaaatggaaaaaggagagatagaggcagaattgtgttgggctaaaaagaggctgttggaagaagcaaacaagtatgagaaaaccattgaagaactgtcaaatgcacgtaatttgaatacctctgccttacagctggaacatgagcatttaattaaactcaatcaaaagaaagacatggaaatagcagaactcaaaaagaatattgaacaaatggatactgaccataaagaaactaaggacgttttgtcatctagtttagaagagcagaagcagttgacacaacttataaacaagaaagaaatttttattgaaaagcttaaagaaagaagttcaaagctgcaggaggaattggataaatattctcaggccttaagaaaaaatgaaattttaagacagaccatagaggaaaaagaccgaagtcttggatccatgaaagaggaaaataatcatctgcaagaagaattggaacgactcagggaagagcagagtcgaaccgcacctgtggctgaccctaaaacccttgatagtgttactgaactagcatctgaggtatctcaactgaacacgatcaaggaacatcttgaagaggaaattaaacatcatcaaaagataattgaagatcaaaaccagagtaagatgcaactacttcagtctttacaagagcaaaagaaggaaatggatgagtttagataccagcatgagcaaatgaacgccacacacacccagctctttttagagaaggatgaggaaattaagagtttgcaaaaaacaattgaacaaatcaaaacccagttgcatgaagaaagacaggacattcaaacagataactctgatatttttcaagaaacaaaagttcagagccttaatatagaaaatggaagtgaaaagcatgatttatctaaagctgaaacggaaagattagtgaaaggaataaaagagcgagaactggagattaaacttctaaatgaaaagaatatatctttaactaaacagattgatcagttgtccaaagatgaagttggtaaactaactcagattattcagcagaaagatttggagatacaagctcttcatgctagaatttcttcaacttcccatactcaagatgttgtttaccttcaacagcaactgcaggcttatgctatggaaagagaaaaggtatttgctgttttgaatgagaagactagggaaaatagccatctaaaaacagaatatcacaaaatgatggatattgttgctgccaaggaagcagctcttatcaaactgcaagatgaaaataaaaaattgtccactagatttgaaagtagtggccaagatatgtttagagaaactattcagaatttatcacgtatcattcgagaaaaagacatcgaaatagatgcactaagtcagaaatgtcagactttattggcagttttacaaacatccagcactggtaatgaggctggaggtgttaatagtaatcaatttgaggagcttctacaggaacgtgacaagttaaaacagcaagtaaagaaaatggaagagtggaagcagcaggtgatgaccacagtacaaaatatgcaacacgagtcagcccagcttcaggaagagcttcaccaacttcaagcacaggttttggttgacagtgataataattctaaattacaagtggactatactggcctgatccaaagttatgagcagaatgaaaccaaactcaaaaattttgggcaggaattagcacaagttcagcacagcattgggcagctttgcaataccaaggatcttcttttaggaaaacttgatattatttcaccccagctgtcttctgcatcattgcttactccccagtctgcagagtgtcttagagcaagtaagtctgaagtattgagtgaatcttctgaattgcttcagcaagagttagaagagctaagaaaatcactacaggaaaaagatgcaacaattagaactctccaggaaaataaccacagattgtctgattcgattgctgccacctcagagctagaaagaaaagaacacgaacaaaccgattcagaaatcaagcagctaaaggagaaacaagatgttttgcaaaagttacttaaggaaaaagacctcttaatcaaagccaaaagtgatcaactactttcttccaatgaaaatttcactaacaaagtaaatgaaaacgaacttttgaggcaggcagtaacaaacctgaaggagagaatattaattctagagatggacattggcaaactaaaaggagaaaatgaaaaaatagtggaaacatacaggggaaaggaaacagaatatcaagcgttacaagagactaacatgaagttttctatgatgctgcgagaaaaagagtttgagtgccactcaatgaaggagaaggctcttgcttttgaacagctattgaaagagaaagaacagggcaagactggagagttaaatcagcttttaaatgcagttaaatcaatgcaggagaagacagttgtgtttcaacaggagagagaccaagtcatgttggccctgaaacaaaaacaaatggaaaatactgccctacagaatgaggttcaacgtttacgtgacaaagaatttcgttcaaaccaagagctagagagattgcgtaatcatcttttagaatcagaagattcttatacccgtgaagctttggctgcagaagatagagaggctaaactaagaaagaaagtcacagtattggaggaaaagctagtttcatcctctaatgcaatggaaaatgcaagccatcaagccagtgtgcaggtagagtcattgcaagaacagttgaatgtagtttccaagcaaagggatgaaactgcgctgcagctttctgtctctcaggaacaagtaaagcagtatgctctgtcactggccaacctgcagatggtactagagcatttccaacaagaggaaaaagctatgtattctgctgaactcgaaaagcaaaaacagcttatagctgaatggaagaaaaacgcagaaaatctggaaggaaaagtgatatcattacaggaatgtttggatgaagcaaatgctgcattggattcagcatcaagacttacagaacagttagatgtaaaagaagaacaaattgaagaacttaaaagacaaaatgagctccgacaagaaatgctggatgatgtacaaaagaaattgatgagcttagcaaacagctcagaaggaaaagtagacaaagtcctaatgagaaacctcttcattggtcatttccacacaccgaaaaatcagcgtcatgaagtgttacggttaatggggagcatcctgggcgtcagaagggaggagatggagcagttgtttcatgacgatcagggcggtgttaccaggtggatgactgggtggcttggaggaggatcaaaaagtgttcccaacacacctttgagaccaaatcagcaatctgtggttaatagttctttttcagaactttttgttaaatttctagaaacagaatctcatccatccattccaccaccaaagctttctgttcatgatatgaaacctctggattcaccaggaagaagaaaaagagatacaaatgcaccagaaagttttaaagatacagcagaatccaggtctggtagaagaacagatgtaaatccgtttttggctcctcgctcggcagctgtacctcttattaacccagctggacttggacctggtgggcccgggcatcttcttctgaaacccatctcagatgttttgcccacatttacacctttgccagcgttacctgacaacagtgctggggttgtgctgaaagaccttttaaagcaatagatgattctcaagccagagacaatctagcactttaaagaaaccatgaacactatatgtatgtactttatcacaaagtggcctttggggagaaagtcatgtatttgttcgcaattatgctttctctgaatttaataaaaatattcctaatgcttttagaaactgcaggtgtcaggagcaagtgtttgctatataatctgctttattccttctgatttgacctaatttaagctaggaacatttaatttatcttttaccttaatttacaaaaatacagacagacaaaaatactagtagctatatggcagctttttatttccttttgtgatttccaagctcatttaagctagagattgtggtttatcaagagagtgttttttttttttaaacgaagaataaaaaaatactagtagtggcttctctgcatagtgcagaaagttgatttgaagcatatattgatcatctttagaggactttgtggagacaggccaacaagattgttgctggaaggtcataggttccctgaggtgaagtatgtatttggtcctgtgcaatattatcatgtgtgtagattctttttttgtttgttttaaatagagatggggtctcactatgttgccaggctggcctcaaactcctgggctcaagtgatcctcccacctcagcctcccaaagtgctgggattaaggcatgagccactgcgcctggccctgtgtgtaaattcatgtgactaccaccacaggcaagacacggaagacttccattacaagcatccccctgtgttgccctctcataatcattgccacctctctccctggccctctccttaatccctgacaaccacttactgttctccatctcagtcattttgttattttgagaatgttatataaatggaatcaatatataccctcttgagactggctttttttcactcagcataattcccttgagatccatccaaggctttggatgtatcactagtttgttcctttttattgttgagcatatagtgcagatatatcacttagttttaacagctaaggtatctatttaaagataccatcttaaaactaaatgttacacaaattcatgcaactttcatataagcattaaaccatacagctgcatctacgtaagtataattagcaaaatcactgaacatgccacttcctgcctccgtctgcggtgttgacatatgaggtacagcaatccgagagtcaactgttatcacggtggccactgagggcagtgaaatcactttgatagcaccagtacccagatgtttgaaacttaagaaagtatttctttaatttttcataaacccatcataaaaaaaaaatcccgacttgaaacttaactgtatctggatgttcatatttttattagttgttgaagttgtacatttaaaaagatatttcttgcaaattttgtaaatttctatatgcttttaaaatagaaacatttgtataacaaggaaggatgaaaataaaacaaattcaaatatgtgaatagtcctggctgaggccagaactaaatttggttatttgcaagttttactgtgattaactgtactttctaatgtatttggaagactggaagtcttaattccatgttgatgggtgaaacttgtttttctgaaaaatgaagtaactgaaaatgctgcttcagaatgtcttgtatctccttagataactaatttatattgccattctttatttactatactttaaaggaagttgtcatgcaagttctatattagaactgtcaaactgcctcttggtttttgcctattattatttctctgtgagttgttactccttggtttttatatgctcctaacaaagatactttcactgactatcctacattatttgctgcttgccattgaaatttcatttcagtgtggagaaatgaaatactagtttctaagttaaaaaagacacatggtcctttatttttaagaaatagaatatgtaaaaagttttctcttttaatttgaaaaagagatgcatggttggtatttaagtagtatgtcatcatatttgaaatgccttttgtgacatttttgagtatttccttctctgaccaaaacaacttgtccgcctctcatcccatggtttaacgtaagtttaaaagctgttgtgggtggattgcatagctaaacatcacagagcatgatattaaatggctgctatttaaataaatatgtgaccttgtcctaaagctataatactggccgggcacagtggctcacgcctgtaatcccagaactttgggagggtgaggtgggtggatcacctgaggtcaggagttcaagaccagcctggccaacatggtgaaaccccatctctactaaaaatacaaaaattagctgggcatggtggcaggcgcctataatcccagctactcaggaggctgaggcaggagaattgcttgaccccgggaagtggaggttgcagttagcaaccactccactgcactccagcctgagcgacagagcgagactctgtctcaaaaaaaaaaaaaaaaaaaaaaaagctatagtacctaatgttttcattgtgtcattgaaactatagctgactggtatgtatactaagtgttcgttgatctaaaccagatataagtcattgacttttctgaaacttagttgtgtcagagatgaaccacctgctcactgaaccgtcttagtaaccagtgatgaagcatataattctaatgttggcaataggacattgctaacagtgcgtttaactgcaatattttaactacagtaatttttctgtttatttctctatccactcagtagaatttgtggttgaattccaccttcgctgccatagttttttaccacattcctaatggttttcaacctctatactgtagtagaaaattcatctaactactgaatttaattttagcataatactggatcaaattgtttgaattttcattcctgtcatttttgatttttaaaaaatgaaacaaaactaaacaacaaaaccctaggaaaagaatggcttctttccaactagtcaattaaaacgtccagtatctccccaaataaagccttaggtttcttttaacctcttaatggttaattgaaaagagtacagaaactatcaaaatacttatccaatcaatggggggaaaagctatgtcttcagggacagtagagtgatgagaattttttagaaaacactattatccatcaaacttaaaagcatttggacctgatatttaaagataatgaagttttccacatattgaagtattcaagacatcttccatccacaaaaatttatctttaagttttgtaaatatcaagtaagtatagatgatatttattttatatattcctatggaaaaaatgctactttaatgttctgacatttgtgattatttgccagtctttactttttaacttattaaaaagttaaatacttattaaggtttctctatgtaaaacaatttaaattgtcttttgatttttagggaaatatctaaacgtgggaaatttccaacgcaaccttaatattaggttgtgttatttatagagctaaagttaatgcatttttgaatttctcaggagcactgcaaggcaaaaaaatactccaaataaaaatgatatatgtaagttggcaatgtcttcagtcacaataaaaaaaatttttagcaaaca

SEQ ID NO: 31616 - DNA, 8001 bp, Homo sapiens
gatccgctgccgctttccgagcgagtgtcatggcggccggcgtcgagttggcaggagtaacccacggaactgaggaaagtcattagagctgagaaagaagtggcccaatctggacggtgggaattcgtgggaatgagcagaaggccctccgtaggtgactgtgtcactagaggcgggcccctggtaaaattccaggccaggcctctgcgtttctaggcagaacctggagtcggccttgcctgagaacccagctttgtgttatcgtatcctgtctcgcgaaggcaggcgttcaaggatatttggtcggatcgcccggcggcgctaaacgttttcttttttccgagcggaccgggtcgttctctaaactcgccgcgatgtcgtcctggcttgggggcctcggctccggattgggccagtctctgggtcaagtcgggggcagcctggcttccctcactggccagatatcaaactttacaaaggatatgctgatggagggcacggaggaagtggaagcagaattacctgattctaggacaaaggaaattgaagccattcatgcaatcttgagatcagagaatgaaaggcttaagaaactttgtactgatctagaagagaaacatgaagcatcagagattcaaataaagcagcaatctacaagttaccgaaatcaacttcaacaaaaagaggtagaaatcagccatcttaaagccagacagattgcactccaggatcagttgctgaaactgcagtcagctgctcagtcagtaccttcaggagctggtgtaccagcaaccactgcatcatcttcattcgcttatgggattagtcatcatccttcagctttccatgacgatgacatggactttggtgatataatttcatcccaacaagaaataaaccgactctcaaatgaagtttcaagacttgagtctgaagttggccattggaggcatattgctcagacttccaaagcacaaggaacagataactctgatcaaagtgaaatatgtaaactacaaaatatcattaaggaactaaaacagaaccgaagtcaggaaattgatgaccatcaacatgaaatgtcagtactgcagaatgcacaccaacagaaattgacagaaataagtcgacgacatcgagaagaattaagtgactatgaagaacgaattgaagaacttgaaaatctgttacaacaaggtggctctggagttatagaaactgatctctctaaaatctatgagatgcaaaaaactattcaagttctacaaatagaaaaagtggagtctaccaaaaaaatggaacaacttgaggataaaataaaagatataaataaaaaattatcttctgcagaaaatgacagagatattttgaggagagaacaagaacagctaaatgtggaaaagagacaaataatggaagaatgtgaaaacttgaaattggaatgtagtaaattgcagccttctgctgtgaagcaaagtgatactatgacagaaaaggaaagaattcttgcccagagtgcatcagtggaagaagtgttcagactacaacaagcactgtctgatgccgaaaatgaaataatgagattgagtagtttaaaccaggaagaacttcagatgtcacttttaaaattgaacaatgaatatgaagtaattaaaagtacagctacaagagacataagtttggattcagaattacatgacttaagacttaatttggaggcaaaggaacaagaactcaatcagagtattagtgaaaaggaaacactgatagctgagatagaagaattggacagacagaatcaagaagctacaaagcacatgattttgataaaagatcagctatcaaaacaacaaaatgaaggagatagcatcatcagtaaactgaaacaagatctaaatgatgaaaaaaagagagttcatcaacttgaagatgataaaatggacattactaaagagttagatgtacagaaagaaaagctaattcaaagtgaagtggccctaaatgatttacatttaaccaagcagaaacttgaggacaaagtagaaaatttagtagatcagctaaataaatcacaagaaagtaatgtaagcatccagaaggagaatttagaacttaaggagcatattagacaaaatgaggaggagctttctagaataaggaatgagttaatgcagtctctaaatcaagactctaatagtaattttaaggataccttacttaaagaaagagaagctgaagttagaaacttaaagcaaaatctttcagaattagaacagctcaatgaaaatttaaagaaagttgcttttgatgtcaaaatggaaaatgaaaagttagttttagcatgtgaagatgtgaggcatcagttagaagaatgtcttgctggtaacaatcagctttctctggaaaaaaacactattgtggagactctaaaaatggaaaaaggagagatagaggcagaattgtgttgggctaaaaagaggctgttggaagaagcaaacaagtatgagaaaaccattgaagaactgtcaaatgcacgtaatttgaatacctctgccttacagctggaacatgagcatttaattaaactcaatcaaaagaaagacatggaaatagcagaactcaaaaagaatattgaacaaatggatactgaccataaagaaactaaggacgttttgtcatctagtttagaagagcagaagcagttgacacaacttataaacaagaaagaaatttttattgaaaagcttaaagaaagaagttcaaagctgcaggaggaattggataaatattctcaggccttaagaaaaaatgaaattttaagacagaccatagaggaaaaagaccgaagtcttggatccatgaaagaggaaaataatcatctgcaagaagaattggaacgactcagggaagagcagagtcgaaccgcacctgtggctgaccctaaaacccttgatagtgttactgaactagcatctgaggtatctcaactgaacacgatcaaggaacatcttgaagaggaaattaaacatcatcaaaagataattgaagatcaaaaccagagtaagatgcaactacttcagtctttacaagagcaaaagaaggaaatggatgagtttagataccagcatgagcaaatgaacgccacacacacccagctctttttagagaaggatgaggaaattaagagtttgcaaaaaacaattgaacaaatcaaaacccagttgcatgaagaaagacaggacattcaaacagataactctgatatttttcaagaaacaaaagttcagagccttaatatagaaaatggaagtgaaaagcatgatttatctaaagctgaaacggaaagattagtgaaaggaataaaagagcgagaactggagattaaacttctaaatgaaaagaatatatctttaactaaacagattgatcagttgtccaaagatgaagttggtaaactaactcagattattcagcagaaagatttggagatacaagctcttcatgctagaatttcttcaacttcccatactcaagatgttgtttaccttcaacagcaactgcaggcttatgctatggaaagagaaaaggtatttgctgttttgaatgagaagactagggaaaatagccatctaaaaacagaatatcacaaaatgatggatattgttgctgccaaggaagcagctcttatcaaactgcaagatgaaaataaaaaattgtccactagatttgaaagtagtggccaagatatgtttagagaaactattcagaatttatcacgtatcattcgagaaaaagacatcgaaatagatgcactaagtcagaaatgtcagactttattggcagttttacaaacatccagcactggtaatgaggctggaggtgttaatagtaatcaatttgaggagcttctacaggaacgtgacaagttaaaacagcaagtaaagaaaatggaagagtggaagcagcaggtgatgaccacagtacaaaatatgcaacacgagtcagcccagcttcaggaagagcttcaccaacttcaagcacaggttttggttgacagtgataataattctaaattacaagtggactatactggcctgatccaaagttatgagcagaatgaaaccaaactcaaaaattttgggcaggaattagcacaagttcagcacagcattgggcagctttgcaataccaaggatcttcttttaggaaaacttgatattatttcaccccagctgtcttctgcatcattgcttactccccagtctgcagagtgtcttagagcaagtaagtctgaagtattgagtgaatcttctgaattgcttcagcaagagttagaagagctaagaaaatcactacaggaaaaagatgcaacaattagaactctccaggaaaataaccacagattgtctgattcgattgctgccacctcagagctagaaagaaaagaacacgaacaaaccgattcagaaatcaagcagctaaaggagaaacaagatgttttgcaaaagttacttaaggaaaaagacctcttaatcaaagccaaaagtgatcaactactttcttccaatgaaaatttcactaacaaagtaaatgaaaacgaacttttgaggcaggcagtaacaaacctgaaggagagaatattaattctagagatggacattggcaaactaaaaggagaaaatgaaaaaatagtggaaacatacaggggaaaggaaacagaatatcaagcgttacaagagactaacatgaagttttctatgatgctgcgagaaaaagagtttgagtgccactcaatgaaggagaaggctcttgcttttgaacagctattgaaagagaaagaacagggcaagactggagagttaaatcagcttttaaatgcagttaaatcaatgcaggagaagacagttgtgtttcaacaggagagagaccaagtcatgttggccctgaaacaaaaacaaatggaaaatactgccctacagaatgaggttcaacgtttacgtgacaaagaatttcgttcaaaccaagagctagagagattgcgtaatcatcttttagaatcagaagattcttatacccgtgaagctttggctgcagaagatagagaggctaaactaagaaagaaagtcacagtattggaggaaaagctagtttcatcctctaatgcaatggaaaatgcaagccatcaagccagtgtgcaggtagagtcattgcaagaacagttgaatgtagtttccaagcaaagggatgaaactgcgctgcagctttctgtctctcaggaacaagtaaagcagtatgctctgtcactggccaacctgcagatggtactagagcatttccaacaagaggaaaaagctatgtattctgctgaactcgaaaagcaaaaacagcttatagctgaatggaagaaaaacgcagaaaatctggaaggaaaagtgatatcattacaggaatgtttggatgaagcaaatgctgcattggattcagcatcaagacttacagaacagttagatgtaaaagaagaacaaattgaagaacttaaaagacaaaatgagctccgacaagaaatgctggatgatgtacaaaagaaattgatgagcttagcaaacagctcagaaggaaaagtagacaaagtcctaatgagaaacctcttcattggtcatttccacacaccgaaaaatcagcgtcatgaagtgttacggttaatggggagcatcctgggcgtcagaagggaggagatggagcagttgtttcatgacgatcagggcggtgttaccaggtggatgactgggtggcttggaggaggatcaaaaagtgttcccaacacacctttgagaccaaatcagcaatctgtggttaatagttctttttcagaactttttgttaaatttctagaaacagaatctcatccatccattccaccaccaaagctttctgttcatgatatgaaacctctggattcaccaggaagaagaaaaagagatacaaatgcaccagaaagttttaaagatacagcagaatccaggtctggtagaagaacagatgtaaatccgtttttggctcctcgctcggcagctgtacctcttattaacccagctggacttggacctggtgggcccgggcatcttcttctgaaacccatctcagatgttttgcccacatttacacctttgccagcgttacctgacaacagtgctggggttgtgctgaaagaccttttaaagcaatagatgattctcaagccagagacaatctagcactttaaagaaaccatgaacactatatgtatgtactttatcacaaagtggcctttggggagaaagtcatgtatttgttcgcaattatgctttctctgaatttaataaaaatattcctaatgcttttagaaactgcaggtgtcaggagcaagtgtttgctatataatctgctttattccttctgatttgacctaatttaagctaggaacatttaatttatcttttaccttaatttacaaaaatacagacagacaaaaatactagtagctatatggcagctttttatttccttttgtgatttccaagctcatttaagctagagattgtggtttatcaagagagtgttttttttttttaaacgaagaataaaaaaatactagtagtggcttctctgcatagtgcagaaagttgatttgaagcatatattgatcatctttagaggactttgtggagacaggccaacaagattgttgctggaaggtcataggttccctgaggtgaagtatgtatttggtcctgtgcaatattatcatgtgtgtagattctttttttgtttgttttaaatagagatggggtctcactatgttgccaggctggcctcaaactcctgggctcaagtgatcctcccacctcagcctcccaaagtgctgggattaaggcatgagccactgcgcctggccctgtgtgtaaattcatgtgactaccaccacaggcaagacacggaagacttccattacaagcatccccctgtgttgccctctcataatcattgccacctctctccctggccctctccttaatccctgacaaccacttactgttctccatctcagtcattttgttattttgagaatgttatataaatggaatcaatatataccctcttgagactggctttttttcactcagcataattcccttgagatccatccaaggctttggatgtatcactagtttgttcctttttattgttgagcatatagtgcagatatatcacttagttttaacagctaaggtatctatttaaagataccatcttaaaactaaatgttacacaaattcatgcaactttcatataagcattaaaccatacagctgcatctacgtaagtataattagcaaaatcactgaacatgccacttcctgcctccgtctgcggtgttgacatatgaggtacagcaatccgagagtcaactgttatcacggtggccactgagggcagtgaaatcactttgatagcaccagtacccagatgtttgaaacttaagaaagtatttctttaatttttcataaacccatcataaaaaaaaaatcccgacttgaaacttaactgtatctggatgttcatatttttattagttgttgaagttgtacatttaaaaagatatttcttgcaaattttgtaaatttctatatgcttttaaaatagaaacatttgtataacaaggaaggatgaaaataaaacaaattcaaatatgtgaatagtcctggctgaggccagaactaaatttggttatttgcaagttttactgtgattaactgtactttctaatgtatttggaagactggaagtcttaattccatgttgatgggtgaaacttgtttttctgaaaaatgaagtaactgaaaatgctgcttcagaatgtcttgtatctccttagataactaatttatattgccattctttatttactatactttaaaggaagttgtcatgcaagttctatattagaactgtcaaactgcc

SEQ ID NO: 31617 - DNA, 6498 bp, Homo sapiens
gctgcggctcagctgataattgaaggaacccggagccgccgccgccgcgccgctggggggggtggggggagctagtggaagttactgccgcgccaccgagtccggaccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagagtaaaactggtggctcttcaaaatttgattgggctgctcgtttcagccctaaagttagccttcctaaaacaaaactgtctcttccagggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgagcaaatcaatgaggacacgggaacagcacgtgccattcagagaaaacctaacccgttagccaatagtaacactagtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaagtcacattgcttccatgctgtcaagccaagacctgaagatagtagtgggagcacttcagatggcagaaattttaatgcagaagttacctgatatttttagtgtttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccacttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagttt

SEQ ID NO: 31618 - DNA, 583 bp, Homo sapiens
ataattgaaggaacccggagccgccgccgccgcgccgctggggggggtggggggagctagtggaagttactgccgcgccaccgagtccggaccggagactttggggcctaactagacagagtctccctctgttgcccaggctggagtgcagtggcgcggtctcagctcactgcaacctctgcctcccgggttcaagcgattcccctgccgcagcctccagagcagctgggactacagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaa

SEQ ID NO: 31619 - DNA, 6405 bp, Homo sapiens
agctgataattgaaggaacccggagccgccgccgccgcgccgctggggggggtggggggagctagtggaagttactgccgcgccaccgagtccggaccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaaggtcacatttagggcaggcaaaacataagggatatagccctcctgagagtagaaaatctaattctaaggcacccaaagtgcagtctaatactacttctgaactgtcaaggggacacctttctaaaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagagtaaaactggtggctcttcaaaatttgattgggctgctcgtttcagccctaaagttagccttcctaaaacaaaactgtctcttccagggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcagcctctagttctgttgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgagcaaatcaatgaggacacgggaacagcacgtgccattcagagaaaacctaacccgttagccaatagtaacactagtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaagtcacattgcttccatgctgtcaagccaagacctgaagatagtagtgggagcacttcagatggcagaaattttaatgcagaagttacctgatatttttagtgtttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccacttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtagga

SEQ ID NO: 31620 - DNA, 5355 bp, Homo sapiens
ccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcagcctctagttctgttgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgaggcagcccatcaggtcggtgaggatgagataagcttgtccactctgggacgagtttatactattgattttaattctatgcagcaaatcaatgaggacacgggaacagcacgtgccattcagagaaaacctaacccgttagccaatagtaacactagtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaagtcacattgcttccatgctgtcaagccaagacctgaagatagtagtgggagcacttcagatggcagaaattttaatgcagaagttacctgatatttttagtgtttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccacttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtagga

SEQ ID NO: 31621 - DNA, 584 bp, Homo sapiens
aaatggaaactaggaagcagctccagtgacaacagttgtgggaagcgagggtcagagaagggagaggccagagagactttagaccgcatgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaaga

SEQ ID NO: 31622 - DNA, 603 bp, Homo sapiens
gtcattatgggtggggctgaagcgcagagcagctgaaacatttttataccaccacccgcacactttcaatgggatagaagggactccaaaagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagt

SEQ ID NO: 31623 - DNA, 1642 bp, Homo sapiens
gcgccgctggggggggtggggggagctagtggaagttactgccgcgccaccgagtccggaccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaaggtcacatttagggcaggcaaaacataagggatatagccctcctgagagtagaaaatctaattctaaggcacccaaagtgcagtctaatactacttctgaactgtcaaggggacacctttctaaaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagagtaaaactggtggctcttcaaaatttgattgggctgctcgtttcagccctaaagttagccttcctaaaacaaaactgtctcttccagggtcttctaagtcagagacatcaaaacctggaccttctggattacaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaa

SEQ ID NO: 31624 - DNA, 2045 bp, Homo sapiens
ggaactagtccggtgcaggacgtggggcttttgcagctcagctggttccggctggggaagatggcggtggctggggcggtgtccggggagccgctggtgcactggtgcacccagcagttgcggaagactttcggcctggatgtcagcgaggagatcattcagtacgttttgtcaattgagagtgctgaagagatacgagaatatgttactgatctcctccagggaaatgaaggcaaaaaaggtcaattcatagaagaacttataaccaaatggcaaaagaatgatcaggagttgatttcggatcctttgcagcagtgcttcaaaaaagatgaaattttagatgggcagaaatcaggcgaccatctaaagcggggtaggaagaaagggagaaacagacaggaagttcctgcatttactgaacctgacacgactgcagaggttaaaacaccttttgatttggccaaggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtgtgtactcatgaggaacaagatattttacagcgtgactcaaacaagagccagaaactgctaaagaaactcatgtcaggagtggagaattctggaaaggtggacatctctaccaaggaccttcttcctcatcaagaattgcgaattaagtctggtctggagaaggctatcaagcataaagacaaactgttagagtttgacagaactagtattcgaaggacccaagtcattgatgatgagtcagattactttgccagtgattctaaccaatggttgtccaaacttgagcgggaaaccttgcagaagcgagaggaggagctgagagaacttcgacacgcctctcgactttctaagaaggtcaccattgactttgcaggaaggaagatcctggaagaagaaaattcactagcagagtatcatagcagactagatgagacaatacaggccattgccaatggaaccttgaaccagccactgaccaaattggatagatcttctgaagagcctttgggagttctggtaaatcccaacatgtaccagtcccctccccagtgggttgaccacacaggtgcagcctcacagaagaaggctttccgttcttcaggatttggactagagttcaactcatttcagcaccagttgcgaatccaggatcaagaatttcaggaaggctttgatggtggctggtgcctctctgtacatcagccctgggcttctctgcttgtcagagggattaaaagggtggagggcagatcctggtacaccccccacagaggacgactttggatagcagccacagctaaaaaaccctcccctcaagaagtctcagaactccaggctacatatcgtcttcttcgtgggaaagatgtggaatttcctaatgactatccgtcaggttgtcttctgggctgtgtggacctaattgactgcttgtcccagaagcaatttaaggagcagtttccagacatcagtcaagagtctgattctccatttgttttcatctgcaaaaatcctcaggaaatggttgtgaagtttcctattaaaggaaatccaaaaatctggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaa

SEQ ID NO: 31625 - DNA, 1942 bp, Homo sapiens
cggggcccggacgcatccgtggacttggaggctggctcgggcccgcacctcccatccccagctgcccgcaacccccagtgactcgggatcccccggagagccctcccctctcggcaggagggggctgactcagggagaaatggcagtttagggcctagggggccacgtgaccctcccccaggaatgtggtgacgtcatcggaggcgtggtcgtccccaaaattagggaggaagaggaaaaaaaaaagccagaaaaagttttcttttctggagtcccaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcagcactccagccccaccccagggtcaatttttgcccccttccatctgagcagtgttaccaggccccagggggaccggaggatcgggggccggcgtgggtggggtcccatggagtactccagcacacgcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtatgttctacatgccgggcccagcttcgcggccagcatttctacgccgtggagaggagggcatattgcgagggctgctacgtggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagactgtgagaattgttgctctggatcgaagttttcacattggctgttacaagtgcgaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaaca

SEQ ID NO: 31626 - DNA, 2538 bp, Homo sapiens
gaggcggcctgcagggagcagccgcgagccggccgggcgcgccgagcccgagccccagccggagcggggcgggggagggaggagccagagcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctgaagccccccagaaggccgatggggaaggagaaggagtgccataccttctcccaggcctctgccccaagagcaggaggtgcctgaaagctgggagcgtgggctcagcagggctggtcacctcccatcccgtaagaccaccttcccttcctcagcaggccaaacatggccagactcccttgctttttgctgtgtagttccctctgcctgggatgcccttccccctttctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattgaa

SEQ ID NO: 31627 - DNA, 2512 bp, Homo sapiens
agcagattgttgggggaaatggctggtgacagagaatagaaagagcctatatggagaagggtgacgttggaaaagggaggcagtggatcggtattgatgttagaaatgagaggggagggaggtaacagggaatgaacccccacaaggatgaaaaacgtaagatgattgaagttaaaaggacatcaggggtcacctgcccagccctcgcagctgaagcttgaggaagctctgcccccgacagcagtggcgatttgtcaagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctgaagccccccagaaggccgatggggaaggagaaggagtgccataccttctcccaggcctctgccccaagagcaggaggtgcctgaaagctgggagcgtgggctcagcagggctggtcacctcccatcccgtaagaccaccttcccttcctcagcaggccaaacatggccagactcccttgctttttgctgtgtagttccctctgcctgggatgcccttccccctttctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattg

SEQ ID NO: 31628 - DNA, 4895 bp, Homo sapiens
gcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggtgactgacctccgcatgatcggggcctgccacgccagccgcttcctccacatgaaagtcgagtgccccaccgaactcttccccccactcttcctcgaggtctttgaggatcaggaagtctaaagcctcaggcggccagagggtgtgcggagctggtggggaggagcctggagagaaggggcagagctgggggctgagggagacccccccacaccccttctctccttcctctcgtccttggatagattcagctcccacacacacacccgcactgcccaggtccctcctcagacctccagccctgggacagggcaaacaactgaacttgctatggaaaggacagtgtgggaggctgggggagctgtgtcctgcagttcccaggaccccatcctctcagaaggtaggggaagggcgggaggattgagaagggacaagccaccttgaccgtaggggaaggaggaatgtgggctgggggaagatgccctcaactcaccccctacacacacatgagagagagcccccacccagttccttggcctaggtctcccctccaggctgagggcctctctacttccccagatgcctgggtgcaaagaacggcttggcttggctcctcctctggaggttaaaatttatagtcattctaactgcactttggaaaccaagcaaggggagaagacaaatgaagaaaaactagacagagagaaaaatacaaaaaagagagagcgagcgatagagagagatgatattaagttattaactgaggctgaccagaggggaggaccccccctttaccaccccatgcactttgcgagctgccccttcttcccccacatcagagagaaatgcccccacaccagagccccaagggtagggctgccgatcagagctgtgagttaacacaacagggtcctggccaccccccttgccataccccgccctctgtgcccctttggcaccccccaaccctagtatgtcctctgctttctgccactcgtgcccgctgagttccatctacctctcatgctggatgccagctggcccctcaccagcctgccctgctgcccacacagctcccctttaagtgcccagccctaggggcctctccccatccacctcctccttccacaccttggcacccacccaggaaaaaactgtggctccaactcctaccctccttatatcctgcagtattagctagaaaccggatgctgctgcattggttgggtcgggggtaggagggctgtgcgtgagcgtctcccagaaccctccacccctttagcactctgtttccctgtttcccatctgtcttctgggctctctctaacctctgccctcctccccagctcctactcactgcactaactctgggcgggcaggtaccagaatgggggtgtttagataagtgacacttagttggggccccaggggaggggtggtcggtgctcctttttctttaaagctcttttggccagctgcccctctgccccgggaccccttcccctcttcttttctctaattcagggactttggcttgagcccctctcgccctcctggtgagggtgctctgttggtctgcacttgggtgagctgtcctcctccccctccctgtggctgccgcccactcctcaggggagagagggagagaggaggtggtcctcccatgggagcaggaggtggggtgggacagagcagaccagagggtgctgggctcagggctgcatgtcggcagggatggatgggtggacacagatgcccccggaagccatggggattggggcagggggtggggggaggggtgccagggcttcctgcgctttgcactattggggcaaaaatgtcttaagcagtggggaacctgccaccccaccctgaccctcagcctgccacagccccctacacacacacacacacacacacacacacacacacacacacggacatgcacacacggacatgggaaggcaatgctatgctgcccgtcagggcactgtccttccccaatcgttcaggtgttccaacaggggtggagggcctggaggagcacccgctgtcacctgtgcatgtgcctgtcccaccctgctggggcctcgggctgcccgcgctgtctttgtctctatcctctctctctctcctggagtactgaatcctgtattactccagtcccatgggtaggccctcttgtaccttcctaccacgcctgggggcccagtggaattcctgacctgtctgctgtcttccccatccctccatccccaccccaacccctccatccccattctcagccatggacacggcagagaaaaggccttgaagagccttagcctcttataggcacttgggactcccccaccctccccaatcatatgagctgtgatcccatcctccccggacccctcccttccccctcggtgatgtggggtgtatgtgtgcgttcctctgcgtgaatgtgtgagtgagtacacatggtaggggaggagccagggcgactcaggagtgccacgcacctgctctagagcggcagctgtcccagtccctgctgtggaagtgggggacagggccctctcctgggggccattggtgctaatgagggggatggccttgatgtgggtgctcagcatgcctcccccagtattggcccggggcactagggcaggcagggtggagcagcaggtgcagtatcggtgggaggacgggttgctgggaataggacgagggggccaggccaggacaaggggttgccagagccatgaccactaccccgcccccaccacccgcctctccatctcagtattgcccctcccatcactcataacacacatacctcatccagcctcctccctgctcagacttggggagggtgggggaggagcccctaccccttctcctggtggcgggtctgcagggctgggagagggcagggcgttgtgagagagagaccgtccataaggaggacagtaactcctgccctgggaactcctgggcgggggggagggggacactgcccagaggcgctactgaatgtatgagaagctggtgctgggctggggggaggggggttgtggccagaaacagggaaggaggtaggtctcttccccagggaggggtgggaccggcaggggtgacttgaggggctcctactcctgccccacgttgacaatcagtatgtctgttatgtgcgatttttcaccccgttgtgttttgggtcaggattttaaagaaagatatttttatggtaattgttgctcgtctattttactatatatttatgtaataaatatatgatgaaaataa

SEQ ID NO: 31629 - DNA, 1909 bp, Homo sapiens
gtgcacgcatccatgtgagagtgtttttgtgcatgtgtgggctggggagggctctgaatatctcctggaacggtacccagagccctgtggctctgcgcatgcgggggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggtgactgacctccgcatgatcggggcctgccacgccagccgcttcctccacatgaaagtcgagtgccccaccgaactcttccccccactcttcctcgaggtctttgaggatcaggaagtctaaagcctcaggcggccagagggtgtgcggagctggtggggaggagcctggagagaaggggcagagctgggggctgagggagacccccccacaccccttctctccttcctctcgtccttggatagattcagctcccacacacacacccgcactgcccaggtccctcctcagacctccagccctgggacagggcaaacaactgaacttgctatggaaaggacagtgtgggaggctgggggagctgtgtcctgcagttcccaggaccccatcctctcag

SEQ ID NO: 31630 - DNA, 6341 bp, Homo sapiens
cggcggggattaactttgcatgaataatgtgagtgcgcttggaaaagagacctcctgctccgcgggctcggggcaagagcccgcaggctaccttccccgggcaggggcgctcaacccaaccggctccagggcactggtaatttggctagaggaccgcgcggaggcagcgggatctgcgatttccttctggttggctgtcctgcgtgggtgccaagttccacacatgatttaatgaataagaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaagggtacatccccagttacttagacaaggacgagctctgtgtagtgtgtggtgacaaagccaccgggtatcactaccgctgtatcacgtgtgaaggctgcaagggtttctttagaagaaccattcagaaaaatctccatccatcctattcctgtaaatatgaaggaaaatgtgtcatagacaaagtcacgcgaaatcagtgccaggaatgtcgctttaagaaatgcatctatgttggcatggcaacagatttggtgctggatgacagcaagaggctggccaagaggaagctgatagaggagaaccgggagaaaagacggcgggaagagctgcagaagtccatcgggcacaagccagagcccacagacgaggaatgggagctcatcaaaactgtcaccgaagcccatgtggcgaccaacgcccaaggcagccactggaagcaaaaacggaaattcctgccagaagacattggacaagcaccaatagtcaatgccccagaaggtggaaaggttgacttggaagccttcagccattttacaaaaatcatcacaccagcaattaccagagtggtggattttgccaaaaagttgcctatgttttgtgagctgccatgtgaagaccagatcatcctcctcaaaggctgctgcatggagatcatgtcccttcgcgctgctgtgcgctatgacccagaaagtgagactttaaccttgaatggggaaatggcagtgacacggggccagctgaaaaatgggggtcttggggtggtgtcagacgccatctttgacctgggcatgtctctgtcttctttcaacctggatgacactgaagtagccctccttcaggccgtcctgctgatgtcttcagatcgcccggggcttgcctgtgttgagagaatagaaaagtaccaagatagtttcctgctggcctttgaacactatatcaattaccgaaaacaccacgtgacacacttttggccaaaactcctgatgaaggtgacagatctgcggatgataggagcctgccatgccagccgcttcctgcacatgaaggtggaatgccccacagaactcttcccccctttgttcttggaagtgttcgaggattagactgactggattcattctcataattcctacagcactactgggtgtcatttcattccattgcctagctcttttttgtttgtttctttgtgttgggagggattatttgggagggaaaagggaagtagtccttggcatagacatggatgaaattgccccttgaatgcgggtacttgaaactattgcatttcgttctccggtcctgtgatgtgaatgctctgaaggttttatggttgtggaggtggggtgggggacaatcattaactcaccagcaccaagcatcaccagctcccacccgtccctggtccaagacttgagtcagcaaaatggcgccacaggacactaaagaagccttaaaaccaagataatacgaccacctccacccaatcctgatgttcgcagggctgaagttaacagagcacagaccacctttagttagatgtggctttcagccttttagggaaagactcgaacaaattttcatctattcaagagcatgctgtttgcagcactctttatggtctcctaggagcataacttggaatgtacaggaatatttgtgtcctaaaaaaatcagctgcccttccaatatcatttttataacgttatggtttaattcaagttatacaaaggtgtgactcaaggatgtgcaggtattgactgatggaggccaacaaggaaaatattttttttcagtgagcccagagaaattagaaatcttcaccaatgtcagtgactgcatggtttccaaaaattcacatagtattacctcacagtaggaaggcttctttcccatttaggctcagagaacacttttacagaaatcaaacctatttacagggtggcaccccttttctgtggcatctgatctgtcatctcccaagctcctgaagttctttatccaggttgtatctttgctgagctgacaacagatttctctatggatcaaatattctaatcaaggaaagatacggtgaaacttcagtcttcttctggagaaatgctgaggcgagattagtgcagctacattctgagttgaaggaaatgcagtgttctgagggcccctttgtgtcctgatggctggaggacgcttcctcctggttagatcctcaagctccttgcctcattgacaaatgtctcctagtcccctttttccctctgactctgaggaactaaatagcttgactatctctaaacagagactggccctgccactgaccctcctgtccctctcatagcataccctgacagatactcaatagaaaacacctgcagaccatgtgcacacttaactttcctgcccaacctgcctccccaacggcccatgctagaatagcttgtgcccagaaaacaaacagtgacacttcatctcttcagcgtcagaaaatgggcatagaatgtacccatgcaattgaatgtatctcattctccactggcatagtagatataaactattcctttgcctaccttttactgccttatcctggaaatattggggaaaataagccatatcagtgagatttacctaaaaacaaaggaaggaaagtcactatggaaaccaagtagatgctttttgtaagtttggtggagcataactggcccagaagtctgggtgcctgagttctagttcgtgctctgtcaactggtagatttgtaattctaggtcttggttttcttacctggtgaataagtcatgatctctaaaacccttcctgcccttaatattgtctgaatttcaaggggaaaaaaaaaatctggttcctttaattatttttttttaacacttaaattcctaactttattagacaagaagtatggcccacttaacagttaaggaacgtaaatttgttattggctcgaaataataatttgacacaatactagtcaaccatttagaggccttggaaaaagaagaggaacagcactgaaaattccaagtatgattggaaattatctgggagcggggaattaaatattcaatgcatgaaagcaattgtactggcttctgggaaaaaggaaacaagaacattgctatggaacttgttacccagagaaaggaagtgaaaagatttacaattataagcacgaaattcattggcagattacctgctttatctacagacagattgttttggggtttggttttgtctaggcagcctctggccaggctccttaattgcttgctctgctaatatttcagcttcctctcttgactccttgaggaaccaaccgctctttggaagacaaacacttagccacctctgtgctccagggtaaccctgagaagctctgctgtctggggcaagctttctttccaaagggaatgagaggaaggcaagcaggcagggtcctgcagcgtcaggccttctggggaaagtttcctcattttgtttgacagggtcctcagtacatcagacacccagatttgaatataagttcagagcctgatctcaagctaaatcagaatgctttggggactaaccatgatcgagaattggccaaatagtatggcatataaacagccatccagccagccgcaagtaaaggaacgtttgatccttggcaccttaaatgattgattgccttcaataggcaaactgctggtctggaaatctcgttgaaggctgaatacttcatgcggagtaggacaagccttagcccaccttcaggttgaaaggaaaggccataggactcaaaagataatgactctgaaactaaactccttccttctgaagctgacagaggtacttagtgcatctcaagactccatctcataaaactcatttgtgagggatttgctctagatttttctaaacattttttcatctattgtccagacttgcaaatccagtgtggacctgatggagatacccttcacacctgcgctcccaccccctcggcagggagacgtctcagtagaggagaacacacccattatgctgggatttgtatttataaatcacttcccttttagggatgagcggtgtggggcgtgtgtgcgtgtgagtgtatgcgcgtgcgtgtgtgaccctcaagtgtactttgctcaatttagacgtgcagtatttccagaaacaatgaaaaaagtaagatgttttcttctttatgattctgctcaaaacaccacgtgccgcctcagagctttttctagagcctcggtcctcaatgacgcgcttgacctgttgatgcctcagcccagcgaagcccctcacctgtgccccgggcgacagctcttcagtgtgcagtgcaggcctggggtggactgccaggccttcgctctgtgccagcaacgccgttcttgttgctcctccatgaacaggggtacaagccctggcccctcctcgacactaagccccccacagactcagcctccaaggaaccgctgagcacccttgaagcatgtcattgtcagtgatacctttttattctatggaactctaacctattcgtgtcatattgaccttttgctgcatgagtcataaattatgaaatcagtcttacagtttttgaaatgtagccagcatttgtaaggctaaacctttttcatgaactgaatttaagtgaataaccaagccacagttcctcctcaaatggagagtgatgatcgacatttgaatctctttgccctttccaacggctatggcatcaggttctaaaataagctcgtaatttttcctgttattttaataatatggaaatattagcatagtgtttcttttgatagtgatagactataatccatatttaaattttatagagaagaaattttattgtactgtgatgtagatatttattatccaggtaaggatttgcccggtgtgtattttttacaattgagacattttactttaatctttaaaaaaaatgcattaaaaacacactcaaaaaaaaaaaaaaaaaaaaaaaaaaaaaaccagactgggggaaaaaaggtttggccttatcacagaatttttactgtgctgtataaatgtttgcaaatgcgaaaagtgtgcatttatagtgtgtttccacattaattaatgccgccttcaagagcaatattgtgcaggtaaaacgctgtttgtggctttctgttgcacagttaaagctgacccaccctatgcacaagacaatcaaatataaatctgtcctcctcaggatgcagataatactcatgtaaattatggagcacaatgtaagacaaaaggagacactttacatatgtattgttgatacagaaattatcagggcatgaatgagctgatgtgacattatgccacttctttcttttggttctcccttattaacttggcatttttaatttgaccatagagccaaattagttctccatgctttcttcgtagaaaatccttttttttcccataatgttttcatgccctgagaatcagaaaaatactacagaatagaaaaagatttacagtcattggaagatttgtgttttgcaaacagtgttaagtgatattgctagatggtgatatttttttcagcctaaaactctgttgaaatctgtgatcaaaatgttttaaactatccaaaaaaaatttgtatatttgggaaaaatggatttttacatagcttttgtatgcagatataaaactgtaattatgaatatagtgggcgtagataaactcataagcttaaattctaaaaaagaaaaagcttataacaga

SEQ ID NO: 31631 - DNA, 7459 bp, Homo sapiens
agacctcctgctccgcgggctcggggcaagagcccgcaggctaccttccccgggcaggggcgctcaacccaaccggctccagggcactgatctgcgatttccttctggttggctgtcctgcgtgggtgccaagttccacacatgatttaatgaataagaagctcgccagagaggcaaactccagcattttatatttcatctgcccccagtgacttcactgtaggaagaggaaatgcagaaaaacaaacgtcttgaagactgaaagcctgttattcaaagaggttagcagtagactgttggaagtaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaagggtacatccccagttacttagacaaggacgagctctgtgtagtgtgtggtgacaaagccaccgggtatcactaccgctgtatcacgtgtgaaggctgcaagggtttctttagaagaaccattcagaaaaatctccatccatcctattcctgtaaatatgaaggaaaatgtgtcatagacaaagtcacgcgaaatcagtgccaggaatgtcgctttaagaaatgcatctatgttggcatggcaacagatttggtgctggatgacagcaagaggctggccaagaggaagctgatagaggagaaccgggagaaaagacggcgggaagagctgcagaagtccatcgggcacaagccagagcccacagacgaggaatgggagctcatcaaaactgtcaccgaagcccatgtggcgaccaacgcccaaggcagccactggaagcaaaaacggaaattcctgccagaagacattggacaagcaccaatagtcaatgccccagaaggtggaaaggttgacttggaagccttcagccattttacaaaaatcatcacaccagcaattaccagagtggtggattttgccaaaaagttgcctatgttttgtgagctgccatgtgaagaccagatcatcctcctcaaaggctgctgcatggagatcatgtcccttcgcgctgctgtgcgctatgacccagaaagtgagactttaaccttgaatggggaaatggcagtgacacggggccagctgaaaaatgggggtcttggggtggtgtcagacgccatctttgacctgggcatgtctctgtcttctttcaacctggatgacactgaagtagccctccttcaggccgtcctgctgatgtcttcagatcgcccggggcttgcctgtgttgagagaatagaaaagtaccaagatagtttcctgctggcctttgaacactatatcaattaccgaaaacaccacgtgacacacttttggccaaaactcctgatgaaggtgacagatctgcggatgataggagcctgccatgccagccgcttcctgcacatgaaggtggaatgccccacagaactcttcccccctttgttcttggaagtgttcgaggattagactgactggattcattctcataattcctacagcactactgggtgtcatttcattccattgcctagctcttttttgtttgtttctttgtgttgggagggattatttgggagggaaaagggaagtagtccttggcatagacatggatgaaattgccccttgaatgcgggtacttgaaactattgcatttcgttctccggtcctgtgatgtgaatgctctgaaggttttatggttgtggaggtggggtgggggacaatcattaactcaccagcaccaagcatcaccagctcccacccgtccctggtccaagacttgagtcagcaaaatggcgccacaggacactaaagaagccttaaaaccaagataatacgaccacctccacccaatcctgatgttcgcagggctgaagttaacagagcacagaccacctttagttagatgtggctttcagccttttagggaaagactcgaacaaattttcatctattcaagagcatgctgtttgcagcactctttatggtctcctaggagcataacttggaatgtacaggaatatttgtgtcctaaaaaaatcagctgcccttccaatatcatttttataacgttatggtttaattcaagttatacaaaggtgtgactcaaggatgtgcaggtattgactgatggaggccaacaaggaaaatattttttttcagtgagcccagagaaattagaaatcttcaccaatgtcagtgactgcatggtttccaaaaattcacatagtattacctcacagtaggaaggcttctttcccatttaggctcagagaacacttttacagaaatcaaacctatttacagggtggcaccccttttctgtggcatctgatctgtcatctcccaagctcctgaagttctttatccaggttgtatctttgctgagctgacaacagatttctctatggatcaaatattctaatcaaggaaagatacggtgaaacttcagtcttcttctggagaaatgctgaggcgagattagtgcagctacattctgagttgaaggaaatgcagtgttctgagggcccctttgtgtcctgatggctggaggacgcttcctcctggttagatcctcaagctccttgcctcattgacaaatgtctcctagtcccctttttccctctgactctgaggaactaaatagcttgactatctctaaacagagactggccctgccactgaccctcctgtccctctcatagcataccctgacagatactcaatagaaaacacctgcagaccatgtgcacacttaactttcctgcccaacctgcctccccaacggcccatgctagaatagcttgtgcccagaaaacaaacagtgacacttcatctcttcagcgtcagaaaatgggcatagaatgtacccatgcaattgaatgtatctcattctccactggcatagtagatataaactattcctttgcctaccttttactgccttatcctggaaatattggggaaaataagccatatcagtgagatttacctaaaaacaaaggaaggaaagtcactatggaaaccaagtagatgctttttgtaagtttggtggagcataactggcccagaagtctgggtgcctgagttctagttcgtgctctgtcaactggtagatttgtaattctaggtcttggttttcttacctggtgaataagtcatgatctctaaaacccttcctgcccttaatattgtctgaatttcaaggggaaaaaaaaaatctggttcctttaattatttttttttaacacttaaattcctaactttattagacaagaagtatggcccacttaacagttaaggaacgtaaatttgttattggctcgaaataataatttgacacaatactagtcaaccatttagaggccttggaaaaagaagaggaacagcactgaaaattccaagtatgattggaaattatctgggagcggggaattaaatattcaatgcatgaaagcaattgtactggcttctgggaaaaaggaaacaagaacattgctatggaacttgttacccagagaaaggaagtgaaaagatttacaattataagcacgaaattcattggcagattacctgctttatctacagacagattgttttggggtttggttttgtctaggcagcctctggccaggctccttaattgcttgctctgctaatatttcagcttcctctcttgactccttgaggaaccaaccgctctttggaagacaaacacttagccacctctgtgctccagggtaaccctgagaagctctgctgtctggggcaagctttctttccaaagggaatgagaggaaggcaagcaggcagggtcctgcagcgtcaggccttctggggaaagtttcctcattttgtttgacagggtcctcagtacatcagacacccagatttgaatataagttcagagcctgatctcaagctaaatcagaatgctttggggactaaccatgatcgagaattggccaaatagtatggcatataaacagccatccagccagccgcaagtaaaggaacgtttgatccttggcaccttaaatgattgattgccttcaataggcaaactgctggtctggaaatctcgttgaaggctgaatacttcatgcggagtaggacaagccttagcccaccttcaggttgaaaggaaaggccataggactcaaaagataatgactctgaaactaaactccttccttctgaagctgacagaggtacttagtgcatctcaagactccatctcataaaactcatttgtgagggatttgctctagatttttctaaacattttttcatctattgtccagacttgcaaatccagtgtggacctgatggagatacccttcacacctgcgctcccaccccctcggcagggagacgtctcagtagaggagaacacacccattatgctgggatttgtatttataaatcacttcccttttagggatgagcggtgtggggcgtgtgtgcgtgtgagtgtatgcgcgtgcgtgtgtgaccctcaagtgtactttgctcaatttagacgtgcagtatttccagaaacaatgaaaaaagtaagatgttttcttctttatgattctgctcaaaacaccacgtgccgcctcagagctttttctagagcctcggtcctcaatgacgcgcttgacctgttgatgcctcagcccagcgaagcccctcacctgtgccccgggcgacagctcttcagtgtgcagtgcaggcctggggtggactgccaggccttcgctctgtgccagcaacgccgttcttgttgctcctccatgaacaggggtacaagccctggcccctcctcgacactaagccccccacagactcagcctccaaggaaccgctgagcacccttgaagcatgtcattgtcagtgatacctttttattctatggaactctaacctattcgtgtcatattgaccttttgctgcatgagtcataaattatgaaatcagtcttacagtttttgaaatgtagccagcatttgtaaggctaaacctttttcatgaactgaatttaagtgaataaccaagccacagttcctcctcaaatggagagtgatgatcgacatttgaatctctttgccctttccaacggctatggcatcaggttctaaaataagctcgtaatttttcctgttattttaataatatggaaatattagcatagtgtttcttttgatagtgatagactataatccatatttaaattttatagagaagaaattttattgtactgtgatgtagatatttattatccaggtaaggatttgcccggtgtgtattttttacaattgagacattttactttaatctttaaaaaaaatgcattaaaaacacactcaaaaaaaaaaaaaaaaaaaaaaaaaaaaaaccagactgggggaaaaaaggtttggccttatcacagaatttttactgtgctgtataaatgtttgcaaatgcgaaaagtgtgcatttatagtgtgtttccacattaattaatgccgccttcaagagcaatattgtgcaggtaaaacgctgtttgtggctttctgttgcacagttaaagctgacccaccctatgcacaagacaatcaaatataaatctgtcctcctcaggatgcagataatactcatgtaaattatggagcacaatgtaagacaaaaggagacactttacatatgtattgttgatacagaaattatcagggcatgaatgagctgatgtgacattatgccacttctttcttttggttctcccttattaacttggcatttttaatttgaccatagagccaaattagttctccatgctttcttcgtagaaaatccttttttttcccataatgttttcatgccctgagaatcagaaaaatactacagaatagaaaaagatttacagtcattggaagatttgtgttttgcaaacagtgttaagtgatattgctagatggtgatatttttttcagcctaaaactctgttgaaatctgtgatcaaaatgttttaaactatccaaaaaaaatttgtatatttgggaaaaatggatttttacatagcttttgtatgcagatataaaactgtaattatgaatatagtgggcgtagataaactcataagcttaaattctaaaaaagaaaaagcttataacagatatattttcctgtctctttctttaaatattattattttctacataggcaaagagttgcctgctcttctcacttcagctgctgccaaaagacggaaccacggatgtaaggacatttatttcataaataaacatctactagaataagcaaatttacttgagaagaaactatggagggagagaagaaactaagtaaaatgctgatggggggttacctctttggaaggggccacaaagatgaagggaggagagaggtgaagttttgcagctcaaggacaacattcatcttctcatctcaaattattcaggaatattactaatggaattatgttaacatcagctgccaacatatatctcaatctctgttgccctgaacacatgttaattgagattctttctatgacaagtaacaaaaagctaactcaaactggcttaagcagaaagctaattattgactttaatatctgggatctagggtattgcataccaaagcttcaggcatggctggatctgggtgcacttactcagtattctcaggaagctcctttttttgtcattcatgtagacttaacattcacatggcctttcaccttacggtggcctccaatagctccaggatgagctttacagctccaaatatagtgaaaggagaatttcttttctccaacaattctaatgaaaattctggcctaattctcactggcccaagttcagtcatgtgcccattcctgagccaatcactgtggtgaggaaaacagatgcataaccaaccttatcctcaggaatcctggaactgggtgaggggaaagagggacagtcagcttcatctaaactatggactgagagttgaggcaagatgattcctgaaagaaaattctaagtcttgctgctataagtggaagagaatggtgggcaagcaaaagcaaccagtgcccacaccaaaggtaaatctaaaacaacatcccatttcagtacagcaagcggttctccttcacacagaggaagctcatctccaagtttttatttggccaggacatgaaccaaataaacaccttcc

SEQ ID NO: 31632 - DNA, 2571 bp, Homo sapiens
aactttgcatgaataatgtgagtgcgcttggaaaagagacctcctgctccgcgggctcggggcaagagcccgcaggctaccttccccgggcaggggcgctcaacccaaccggctccagggcactggtaatttggctagaggaccgcgcggaggcagcgggatctgcgatttccttctggttggctgtcctgcgtgggtgccaagttccacacatgatttaatgaataagaagggggcttggaggctcatagcaaaggtccttgaagagagcaagaaaaagtcttcccaggaaaagtggacacctgagtgagtgttacaacgagaaggggggcatcccaggcaaggcagctaccaagcacaggtgtgaagtgacttcactgtaggaagaggaaatgcagaaaaacaaacgtcttgaagactgaaagcctgttattcaaagaggttagcagtagactgttggaagtaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaagggtacatccccagttacttagacaaggacgagctctgtgtagtgtgtggtgacaaagccaccgggtatcactaccgctgtatcacgtgtgaaggctgcaagggtttctttagaagaaccattcagaaaaatctccatccatcctattcctgtaaatatgaaggaaaatgtgtcatagacaaagtcacgcgaaatcagtgccaggaatgtcgctttaagaaatgcatctatgttggcatggcaacagatttggtgctggatgacagcaagaggctggccaagaggaagctgatagaggagaaccgggagaaaagacggcgggaagagctgcagaagtccatcgggcacaagccagagcccacagacgaggaatgggagctcatcaaaactgtcaccgaagcccatgtggcgaccaacgcccaaggcagccactggaagcaaaaacggaaattcctgccagaagacattggacaagcaccaatagtcaatgccccagaaggtggaaaggttgacttggaagccttcagccattttacaaaaatcatcacaccagcaattaccagagtggtggattttgccaaaaagttgcctatgttttgtgagctgccatgtgaagaccagatcatcctcctcaaaggctgctgcatggagatcatgtcccttcgcgctgctgtgcgctatgacccagaaagtgagactttaaccttgaatggggaaatggcagtgacacggggccagctgaaaaatgggggtcttggggtggtgtcagacgccatctttgacctgggcatgtctctgtcttctttcaacctggatgacactgaagtagccctccttcaggccgtcctgctgatgtcttcagatcgcccggggcttgcctgtgttgagagaatagaaaagtaccaagatagtttcctgctggcctttgaacactatatcaattaccgaaaacaccacgtgacacacttttggccaaaactcctgatgaaggtgacagatctgcggatgataggagcctgccatgccagccgcttcctgcacatgaaggtggaatgccccacagaactcttcccccctttgttcttggaagtgttcgaggattagactgactggattcattctcataattcctacagcactactgggtgtcatttcattccattgcctagctcttttttgtttgtttctttgtgttgggagggattatttgggagggaaaagggaagtagtccttggcatagacatggatgaaattgccccttgaatgcgggtacttgaaactattgcatttcgttctccggtcctgtgatgtgaatgctctgaaggttttatggttgtggaggtggggtgggggacaatcattaactcaccagcaccaagcatcaccagctcccacccgtccctggtccaagacttgagtcagcaaaatggcgccacaggacactaaagaagccttaaaaccaagataatacgaccacctccacccaatcctgatgttcgcagggctgaagttaacagagcacagaccacctttagttagatgtggctttcagccttttagggaaagactcgaacaaattttcatctattcaagagcatgctgtttgcagcactctttatggtctcctaggagcataacttggaatgtacaggaatatttgtgtcctaaaaaaatcagctgcccttccaatatcatttttataacgttatggtttaattcaagttatacaaaggtgtgactcaaggatgtgcaggtattgactgatggaggccaacaagg

SEQ ID NO: 31633 - DNA, 539 bp, Homo sapiens
gtaatttggctagaggaccgcgcggaggcagcgggatctgcgatttccttctggttggctgtcctgcgtgggtgccaagttccacacatgatttaatgaataagaaggagatgtcagtgaaaaaagggatccagaatgattactaacctatgactcccaacagtatgacagaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaaggtaaccagatttttattagcccattatcatgtgtttcaacaagaaaaaaaatatccctgttgtagctgtgtacttcatctacatttctcttccaatgtatggtgtccc

SEQ ID NO: 31634 - DNA, 703 bp, Homo sapiens
tgacattttgcaggactcgcgcgacgcccagtcgccggcgctccccgggaccccgccgccgggaggagggggcggaggagggtggagactgcggggcttggccaaggaaggcgcacatcctcgggcgggcggccgtgacgcggcggggattaactttgcatgaataatgtcctagaaaggaaagcacagcacatcgtgcagaaggccgcatgggaaaagggccagatctgcgatttccttctggttggctgtcctgcgtgggtgccaagttccacacatgatttaatgaataagaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaagggtacatccccagttacttagacaaggacgagctctgtgtagtgtgtggtgacaaagccaccgggtatcactaccgctgta

SEQ ID NO: 31635 - DNA, 1174 bp, Homo sapiens
attgtgtcagaggaagcaaccatgcaggtgctaaccaagcgttaccccaagaactgcctgctgaccgtcatggaccggtatgcagccgaggtgcacaacatggagcaggtggtgatgatccccagccttctgcgggacgtgcagctgagtgggcctgggggccaggcccaggctgaggcccctgatctctacacctacttcaccatgctcaaggccatctgtgtggatgtggaccatgggctgctgccgcgggaggagtggcaggccaaggtggcaggcagcgaagagaatggaaccgcagagacagaggaagtcgaggacgagagtgcctcaggagagctggacctggaagcccagttccacctgcacttctccagcctccatcacatcctcatgcacctcaccgagaaagcccaggaggtgacaaggaaataccaggaaatgacgggacaagtttggtagaccttggacactagggaagatcccttcacatgatagaagacagactctttgatgaggtcggcggagcagttcactagccaatgatgagagcagaaaggcctagacctgcagccagaagtgaaggcggctcagttctccgggatgcttctctacctcctgagcaccaattcctggattccagtcactggctcacctttagaatgtctgttgctattcactgctcccctcgctcctcttaacagcttggggaggtgaccagtggttcaggagggactagacaattacctgtccagtgtggtatggtaggaagagtgtaggtgttggcacgtgaccaaaattcacatccctcctcatggcagtcattcagtatgtgtacttgtacaagttatttaacccattggagcctaaattccctcatctataaaatggggataatattatctacctcacaagcttatgaaaactaaacatgatgaatcaaaagcacttggcatgtgagggctattaaaatagcctgattttttttttctccccctctccccaatgtatttgctctggcccttgctttttaccctccagagctaagaggtagcagagtctcttgggatgagtgattcaccctcttacttggcgaccactgatgagatcaacaacaggtgaactataaacctattatttattgcagaactaataaaaaatccaaagccttgta

SEQ ID NO: 31636 - DNA, 3138 bp, Homo sapiens
aggcaattaaggcgcccatttcagaagagttacagccgtgaaaattactcagcagtgcagttggctgagaagaggaaaaaagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagatta

SEQ ID NO: 31637 - DNA, 3015 bp, Homo sapiens
ggaaggcaattaaggcgcccatttcagaagagttacagccgtgaaaattactcagcagtgcagttggctgagaagaggaaaaaaggtcagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagatt

SEQ ID NO: 31638 - DNA, 3145 bp, Homo sapiens
ggaaggcaattaaggcgcccatttcagaagagttacagccgtgaaaattactcagcagtgcagttggctgagaagaggaaaaaaggtcagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagatt

SEQ ID NO: 31639 - DNA, 3013 bp, Homo sapiens
ggaaggcaattaaggcgcccatttcagaagagttacagccgtgaaaattactcagcagtgcagttggctgagaagaggaaaaaaggtcagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagatt

SEQ ID NO: 31640 - DNA, 2626 bp, Homo sapiens
ggaaggcaattaaggcgcccatttcagaagagttacagccgtgaaaattactcagcagtgcagttggctgagaagaggaaaaaaggtcagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaaatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagatt

SEQ ID NO: 31641 - DNA, 2283 bp, Homo sapiens
atgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaaatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctga

SEQ ID NO: 31642 - DNA, 2956 bp, Homo sapiens
catttcagaagagttacagccgtgaaaattactcagcagtgcagttggctgagaagaggaaaaaaggtcagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagatta

SEQ ID NO: 31643 - DNA, 542 bp, Homo sapiens
actctgtctccttccgttaattttagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggc

SEQ ID NO: 31644 - DNA, 3143 bp, Homo sapiens
ggaaggcaattaaggcgcccatttcagaagagttacagccgtgaaaattactcagcagtgcagttggctgagaagaggaaaaaaggtcagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagatt

SEQ ID NO: 31645 - DNA, 1157 bp, Homo sapiens
ggaaggcaattaaggcgcccatttcagaagagttacagccgtgaaaattactcagcagtgcagttggctgagaagaggaaaaaaggtcagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagaaaaatgaaatataagcccgaccattccgaaactgccaactaacctgtttaactaggaaccttccagcaggacagaccaaataatgcgaaactgaagccagtcaaagcttttctccaatgacgtctacatccacctgcaaagcctgcccctgggtcctgcagtagagcctgaacctttctttggtttgatgcttcctgattcataaatcatgatcactcaaaaaaaactctttaaaaaatgtattgtgcctaagtttacattttaacaacctcaagaccagggcctcagccggcagcagtgagttcctgctcggcccttctgaaaggccctgctgctgtcttgggcgcctctgccccagctgctgggcgggctccactgacgctcctgggagaatctctgctgaccacacaatgacattggcactgggagctgtgatctggggacacttagatctgagctggtttctctccttctgtggtaacagctacagttttcattaagaattcacagcatctggatctaaaatctcctacgttcaaggcttcacacattgtattccaccaaaaataaaacatctgctcag

SEQ ID NO: 31646 - DNA, 4400 bp, Homo sapiens
cctcctccacagtggtgaggtcacagccccttggagccctccctcttcccacccctcccgctcccgggtctcctttggcctggggtaacccgaggtgcagagctgagaatgaggcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcttttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattgccaagaggatggctgtgttgatcttcaccgacttcatatgcatggccccaatctcattctatgctctgtcagcaattctgaacaagcctctcatcactgttagcaactccaaaatcttgctggtactcttctatccacttaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgagatgaggcagggtctccacaacatggaagatgtctatgaactgattgaaaactcccatctaaccccaaagaagcaaggccaaatctcagaagagtatatgcaaacggttttgtaagttaacactacactactcacaatggtaggggaacttacaaaataatagtttcttgaatatgcattccaatcccatgacacccccaacacatagctgccctcactcttgtgcaggcgatgtttcaatgtttcatggggcaagagtttatctctggagagtgattagtattaacctaatcattgcccccaagaaggaagttaggctaccagcatatttgaatgccaggtgaaatcaaaataatctacactatctagaagactttcttgatgccaagtccagagatgtcattgtgtaggatgttcagtaaatattaactgagctatgtcaatatagagcttctcagttttgtataacatttcatactaaagattcagcaaatggaaaatgctattaatttggttggtgaccacaagataaaatcagtcccacgttggctcagttcaactagatgttccctgatacaaagagaacttgatttccttaaaactgaaaagccaaacacagctagctgtcatacaagaaacagctattatgagacatgaaggagggtaagaattagctttaagttttgttttgctttgttttgttttttaactcaacctattaatcatctcttcacaagaatccacctgatgtgaccaagctattatgtgttgcctggaaaaactggcaagatttcagcttatgtggcctagcaaactaagaattgctcttcttggccagcctcatagcataaaagatgtgaactctaggaagtctttctgagtagcaataagtgggaattatgggcagagcacactcaatcccctgttgattaataaaacaggctggacactaattaactatgggacttaaatctgtagaaatgaaggagtccaatagcttcttccaattttaaaactctagtacatccctttccctcaaatatatatttctaagataaagagaaagaagagcactaagtaagtagaatctgtttttcctattttgtagggctgctgactcctagtccttgaagcctagacacatgacccaggaaatttttcctttgtttcacttttgattatgatgtctgagccaaaaattcaattaagtaaacatactcgcctggatctgaatcattcatttaattactagatctacccagctgttatatcaggccaaaaacagattcgtgtttatataaaagagtaaacgatggttgcaaattttggctatttagagttgctacttcactatgaagagtcacttcaaaacacttcgcttgtctttagggatgatttttgccatttccagtccacggtatgatactaaagctgtcaagagaggtttcttcttttctgaaactgccagctctttccagccctgttgatcactggacataaagcttcttttccccaataattcttctttacttaaaatagtcaggatctttatctacagatgtactctccaggttacctgtgatgatagccccctaatgtcctgctagaaaagtctccaagcagagatgacattacttctgaatgctcataaaccacaccatgaaataaaagctctttgttgttttaagattgtgaagtgtcgttaatgggtccccacagatggtccctgctggactcacctggaatctctccacagccatacccactcatcactatcattgagacctgcacatcttaatagaaatattataaacatcgaaaatcatgacttacctagaagttcgcttgtaactaatgaaattaaacaaatgtgttgccttttgtcatgtgtttctctcctgtgacatttcaaaatatcacatcttgataaataatgtgtttcatcttgaatagctgaactaattgctttggaaacagagtcctagaaaagtgacttcaacagaattgttactaaaatttgcactcacaacatgaaataaattttcttcctatggaataatcgtg

SEQ ID NO: 31647 - DNA, 1281 bp, Homo sapiens
gtccagccaaggaaagtgaagcaagcagacttgtttgggtcaaggttgcctagggaagcggagcacttaagtgcctctttttccccttctccagcctcctccacagtggtgaggtcacagccccttggagccctccctcttcccacccctcccgctcccgggtctcctttggcctggggtaacccgaggtgcagagctgagaatgaggcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctgctacctcttggaagaaagtccttgtcctttgagactcagaaggccccacgctccagtatgccatcatgatgcctgctaaggcagccaccttggtgtacatgctcacagaggctctgttcatggagcagctgctgtttgaaaaattttgaaatgcaagatccacaactagatggaaggcactctagtctttgcagaaaaaaatgtacctgaatgtacattgcacaatgcctggcacaaagaaggaagaatataaatgatagttcgactcgtctgtggaagaacttacaatcatggggaaagatggaataaaaacattttttaaacagcatgaaaacata

SEQ ID NO: 31648 - DNA, 1664 bp, Homo sapiens
ggaaaacagaggggacagccaggactggtgttgggtgtcagggaacagacggagcggactgcgtgggtccagccaaggaaagtgaagcaagcagacttgtttgggtcaaggttgcctagggaagcggagcacttaagtgcctctttttccccttctccagcctcctccacagtggtgaggtcacagccccttggagccctccctcttcccacccctcccgctcccgggtctcctttggcctggggtaacccgaggtgcagagctgagaatgaggcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattgccaagaggatggctgtgttgatcttcaccgacttcatatgcatggccccaatctcattctatgctctgtcagcaattctgaacaagcctctcatcactgttagcaactccaaaatcttgctggtactcttctatccacttaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgagatgaggcagggtctccacaacatggaagatgtctatgaactgattgaaaactcccatctaaccccaaagaagcaaggccaaatctcagaagagtatatgcaaacggttttgtaagttaacactacactactcacaatggtaggggaacttacaaaataatagtttcttgaatatgcattccaatcccatgacacccccaacacatagctgccctcactcttgtgca

SEQ ID NO: 31649 - DNA, 4566 bp, Homo sapiens
caggggtgcagggcgacggcttcggccgcaccgcgggctagccagggctgcgtgcccgcctctgaccctcagcagaggtgtctctggccaggaggagctgaagttctgcaggacattggtccgcccgcggacagtccactccgcggggactttctctggataaggacctcctccacagtggtgaggtcacagccccttggagccctccctcttcccacccctcccgctcccgggtctcctttggcctggggtaacccgaggtgcagagctgagaatgaggcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcttttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattgccaagaggatggctgtgttgatcttcaccgacttcatatgcatggccccaatctcattctatgctctgtcagcaattctgaacaagcctctcatcactgttagcaactccaaaatcttgctggtactcttctatccacttaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgagatgaggcagggtctccacaacatggaagatgtctatgaactgattgaaaactcccatctaaccccaaagaagcaaggccaaatctcagaagagtatatgcaaacggttttgtaagttaacactacactactcacaatggtaggggaacttacaaaataatagtttcttgaatatgcattccaatcccatgacacccccaacacatagctgccctcactcttgtgcaggcgatgtttcaatgtttcatggggcaagagtttatctctggagagtgattagtattaacctaatcattgcccccaagaaggaagttaggctaccagcatatttgaatgccaggtgaaatcaaaataatctacactatctagaagactttcttgatgccaagtccagagatgtcattgtgtaggatgttcagtaaatattaactgagctatgtcaatatagagcttctcagttttgtataacatttcatactaaagattcagcaaatggaaaatgctattaatttggttggtgaccacaagataaaatcagtcccacgttggctcagttcaactagatgttccctgatacaaagagaacttgatttccttaaaactgaaaagccaaacacagctagctgtcatacaagaaacagctattatgagacatgaaggagggtaagaattagctttaagttttgttttgctttgttttgttttttaactcaacctattaatcatctcttcacaagaatccacctgatgtgaccaagctattatgtgttgcctggaaaaactggcaagatttcagcttatgtggcctagcaaactaagaattgctcttcttggccagcctcatagcataaaagatgtgaactctaggaagtctttctgagtagcaataagtgggaattatgggcagagcacactcaatcccctgttgattaataaaacaggctggacactaattaactatgggacttaaatctgtagaaatgaaggagtccaatagcttcttccaattttaaaactctagtacatccctttccctcaaatatatatttctaagataaagagaaagaagagcactaagtaagtagaatctgtttttcctattttgtagggctgctgactcctagtccttgaagcctagacacatgacccaggaaatttttcctttgtttcacttttgattatgatgtctgagccaaaaattcaattaagtaaacatactcgcctggatctgaatcattcatttaattactagatctacccagctgttatatcaggccaaaaacagattcgtgtttatataaaagagtaaacgatggttgcaaattttggctatttagagttgctacttcactatgaagagtcacttcaaaacacttcgcttgtctttagggatgatttttgccatttccagtccacggtatgatactaaagctgtcaagagaggtttcttcttttctgaaactgccagctctttccagccctgttgatcactggacataaagcttcttttccccaataattcttctttacttaaaatagtcaggatctttatctacagatgtactctccaggttacctgtgatgatagccccctaatgtcctgctagaaaagtctccaagcagagatgacattacttctgaatgctcataaaccacaccatgaaataaaagctctttgttgttttaagattgtgaagtgtcgttaatgggtccccacagatggtccctgctggactcacctggaatctctccacagccatacccactcatcactatcattgagacctgcacatcttaatagaaatattataaacatcgaaaatcatgacttacctagaagttcgcttgtaactaatgaaattaaacaaatgtgttgccttttgtcatgtgtttctctcctgtgacatttcaaaatatcacatcttgataaataatgtgtttcatcttgaatagctgaactaattgctttggaaacagagtcctagaaaagtgacttcaacagaattgttactaaaatttgcactcacaacatgaaataaattttcttcctatggaataatcgtg

SEQ ID NO: 31650 - DNA, 1089 bp, Homo sapiens
agaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctggtagaaaatgttgctgtctcgggtaaaggcttctgcaagtccctcttttcctggctgtataggctacctcttggaagaaagtccttgtcctttgagactcagaaggccccacgctccagtatgccatcatgatgcctgctaaggcagccaccttggtgtacatgctcacagaggctctgttcatggagcagctgctgtttgaaaaattttgaaatgcaagatccacaactagatggaaggcactctagtctttgcagaaaaaaatgtacctgaatgtacattgcacaatgcctggcacaaagaaggaagaatataaatgatagttcgactcgtctgtggaagaacttacaatcatggggaaagatggaat

SEQ ID NO: 31651 - DNA, 4394 bp, Homo sapiens
attgggcgcctgcgcagtagctgcccgtgtcggcagctgcagcgggtcgcacggctccggcccatctcggggggcgggcgggggaggcgaggtgcgcgagccgagtccggggcacgatgtccgacgcgggcggcggaaagaagccgcctgtggacccgcaggcaggacccggtccggggccggggcgcgcagctggggaaaggggcctgtcggggtccttccccctggtcctgaagaagctgatggagaaccccccgcgcgaggcgcgcctcgataaggaaaaggggaaggaaaagctggaggaggacgaggccgcagccgccagcaccatggctgtctcagcctccctcatgccacccatctgggacaagaccatcccatatgatggcgaatctttccacctggagtacatggacctggatgagttcctgctggagaatggcatccccgccagccccacccacctggcccacaacctgctgctgcctgtagcagagctagaagggaaggagtctgccagctcttccacagcatccccaccatcctcctccactgccatctttcagccctctgaaaccgtgtccagcacagaatcttccctggagaaggagagggagactcccagtcccatcgaccccaattgtgtggaagtggatgtgaacttcaatccggaccccgccgacctggtgctctccagtgtgccaggcggggagctcttcaaccctcggaagcacaagtttgctgaggaggacctgaagccccagcctatgatcaaaaaggccaagaaggtctttgtccccgacgagcagaaggatgaaaagtactggacaagacgcaagaagaacaacgtggcagctaaacggtcacgggatgcccggcgcctgaaagagaatcagatcaccatccgggcagccttcctggagaaggagaacacagccctgcggacggaggtggccgagctacgcaaggaggtgggcaagtgcaagaccatcgtgtccaagtatgagaccaaatacgggcccttgtaacccgtgccccccgcccgggcggggtactgcctgcacctcagacctctgcctgggggctccctgtaacccctcacacgcgtggagacttatgactcgtcgtgggcgcatggcggcgcacctgctgcaggagcggccacgtctcagcttcattataccatggcctgcgcacgtggcgacgtccctgaggggccagtctcctcactggtggggaacgcaagagaatctgcgtagatgggtgactcagccttagtttctattcttggatgtcccagttgaatcagaaggggacctctggagtacacacctctctcctgggcgctcagggtccctggactctccctcagtctccagcctgggctgccgagggctatctctgcagaatgagttgtgatcattgtcaccctatgtcttctcaggtagcagggcgcgtttccacttaaggtgtgtctgtcacgcacctcattctccccagacagtctttgagtaacatctgttcccatcttccttggaagcaggacacaccagctcctccgtcagtgtctgcatgggtagcaggctgcaggagtggggtctctgcacagcctgggatggggcttggggctggggcctgcagcagaagtgtgcccagcgtttctcggctcccgcaccccttttcccttatggctctgaggccatcggctgtctctgcatttcattggctgtggaggagagactcctaggatggctgctgtctgagccatgagtgccagggctgagagaggcctcttcatttcctctccaggctactcagaggccatgtgaagctcgtttgtcccactagaccaggcctctgggcctgctctttctttccacccaatgtccagtcttggatcatagatttaaaaggaaaacccctcttatctaggaggctttaacttcctggaccccaggattcaccttcctagtggtgtttagaaaatgcctccacagcccccttccaccatgggcatgagagctggggtgtgtttcttgagaagctcccttttttcttgctctgctcaccggtgtggcctgggctggagtgcactctccctgggggcagctggggcctcgcaattcttgcttcaggatctctcccatgcgagctgcccggagggtgtcagcagggcaagacacctagtctagagtcaccaaggtcacagtgccactttcacgggatagcaggctcttgggacttttacacaggcctagggtcccctcagtcttggtcccaggagatgggggccactcgtgaggctggccatgctgtggcttctcacagctgtggtctcccctgcctcacaacgactcctttctcttgtgtggcgggactcgcccttttgctgtgctcagaagattcactgaggaaactcatggaagcctctgctcatttgggtcactgggacacccctgagatgggtgtgtttatttgctcagggcgggcagcctatggtgaagaggagacagaggcgatgggcgtgcttcgtcctccgtaacactggctttatttaccgtggtggttcagagtcccaggccctgacctctaaagacttttcataacagacgttaagaccaagccgtggacctcaccccaggggaatgccacggccctttggggacctgcacacccacctctccgggggacttgacaaggggccctgaggccaagggaggtcactcctccctccaggcccctgacttttactttgtggttctctaaaaaccatgtacacactttcactctattgtaaccacacagggcaggcgcatccagcatgtcagtgtcctgccccgggcagctctccctcccgggcacgctccctctggcctggtggatcaccaagagggcggttctcattttgttattagtggaagagccttgagcttaaaagctcttcattttctttgccggaaagtatatggtttgtgtttttgcagttttatttttttaaggatggacactaaatctctggtgtccatgttccgagcccggtggctgggatggtggctcgatgtgtctcctctttatcccgccctctgcctgtttggtgccctcccttctttcccccaggcagtgggtatcgggttctttcccaaagtgcttacttggaaagagtgtggctgctggactcttttcgaaatgcccctctgagtcaggagcctggtggggacaagatggaggatgtccacagaggctgacctgtgggggaaaagaagtgctcaggtaaggttgtctcctctcctgtcctaaaaaaatccatgcttgcaggagagggttggtgcctgctcagtttctgtcgagggaatgggagtctcctcggctccctcctgggccctctgcttcttggaggccgaccgctggagactgcggctcctgtgcttggatctttgacatctgtcagtcactggaggctagagaagttgactttaccttggctttctgtgggttcccgatgggcttggaagtgccgtctacttcctaagcatcctgtctaaagctttgtggcaccctcagtgcaacctcagaacagacaaatcatgaatgagctggaactttgcaagaatattcatattataaatgtctcatctgatggaggaacgtgtgcatttagagagagggagagttttcaaggtttatggcaactttgtggaggacctgggtaactcttacccttggccaaaggaagaggttttcctgtctggcttctgaggttggagggggcacttagcagtgaaccttaagtctgggtacatgtaaccctgctgaggggctgtgcaggccgctcctacggtcctttggcctgaggcagggcgggaggcatgcaagccagtgggggaaaacccctctgaagctgggcagccctctacctgggccccgggagccgtgctccttggaacgcaaagggccgaggagcatctggttttcatggcaaagctctactccagagctcctttaacatctgctaattaagtgcaataaatttttctagaaaatggcaaagatgacttccaggtggatattgctctcttacggtgttggggatgccagaacaccacttggttttatttttctaagtgcatgtgatgtgatagagtgtgtggggctctgtgtccttccctgggagctggcattccagcgggcccctctctttacctttgttgggggaaggaggcaagagagaaattccttcttcccagccagagagggcagaagcagaccgtagcccattggccttatgtgcgtgtgtgcgtgcgagtgtgtcactgctggtgggccggagtgatgtggtgggagggaagccgggaatgtatccttttcagacaaaattaaatattttgaaatgagaa

SEQ ID NO: 31652 - DNA, 551 bp, Homo sapiens
gcttcatctttttgcctaggccaggaacgtcactggggcgtatacggaaagcagataaggaaaaggggaaggaaaagctggaggaggacgaggccgcagccgccagcaccatggctgtctcagcctccctcatgccacccatctgggacaagaccatcccatatgatggcgaatctttccacctggagtacatggacctggatgagttcctgctggagaatggcatccccgccagccccacccacctggcccacaacctgctgctgcctgtagcagagctagaagggaaggagtctgccagctcttccacagcatccccaccatcctcctccactgccatctttcagccctctgaaaccgtgtccagcacagaatcttccctggagaaggagagggagactcccagtcccatcgaccccaattgtgtggaagtggatgtgaacttcaatccggaccccgccgacctggtgctctccagtgtgccaggcggggagctcttcaaccctcggaagcacaagtttgctgaggaggacctgaagccccagcctatg

SEQ ID NO: 31653 - DNA, 2810 bp, Homo sapiens
agctgcctctgaactccctggagcaagcacctcctgctgggctgtgtgagctgcgactggttctcagtggcccctgccatggacatgcctgaggtcctcaagtccctgctggagcactctctgccttggccagagaagagaacagataaggaaaaggggaaggaaaagctggaggaggacgaggccgcagccgccagcaccatggctgtctcagcctccctcatgccacccatctgggacaagaccatcccatatgatggcgaatctttccacctggagtacatggacctggatgagttcctgctggagaatggcatccccgccagccccacccacctggcccacaacctgctgctgcctgtagcagagctagaagggaaggagtctgccagctcttccacagcatccccaccatcctcctccactgccatctttcagccctctgaaaccgtgtccagcacagaatcttccctggagaaggagagggagactcccagtcccatcgaccccaattgtgtggaagtggatgtgaacttcaatccggaccccgccgacctggtgctctccagtgtgccaggcggggagctcttcaaccctcggaagcacaagtttgctgaggaggacctgaagccccagcctatgatcaaaaaggccaagaaggtctttgtccccgacgagcagaaggatgaaaagtactggacaagacgcaagaagaacaacgtggcagctaaacggtcacgggatgcccggcgcctgaaagagaatcagatcaccatccgggcagccttcctggagaaggagaacacagccctgcggacggaggtggccgagctacgcaaggaggtgggcaagtgcaagaccatcgtgtccaagtatgagaccaaatacgggcccttgtaacccgtgccccccgcccgggcggggtactgcctgcacctcagacctctgcctgggggctccctgtaacccctcacacgcgtggagacttatgactcgtcgtgggcgcatggcggcgcacctgctgcaggagcggccacgtctcagcttcattataccatggcctgcgcacgtggcgacgtccctgaggggccagtctcctcactggtggggaacgcaagagaatctgcgtagatgggtgactcagccttagtttctattcttggatgtcccagttgaatcagaaggggacctctggagtacacacctctctcctgggcgctcagggtccctggactctccctcagtctccagcctgggctgccgagggctatctctgcagaatgagttgtgatcattgtcaccctatgtcttctcaggtagcagggcgcgtttccacttaaggtgtgtctgtcacgcacctcattctccccagacagtctttgagtaacatctgttcccatcttccttggaagcaggacacaccagctcctccgtcagtgtctgcatgggtagcaggctgcaggagtggggtctctgcacagcctgggatggggcttggggctggggcctgcagcagaagtgtgcccagcgtttctcggctcccgcaccccttttcccttatggctctgaggccatcggctgtctctgcatttcattggctgtggaggagagactcctaggatggctgctgtctgagccatgagtgccagggctgagagaggcctcttcatttcctctccaggctactcagaggccatgtgaagctcgtttgtcccactagaccaggcctctgggcctgctctttctttccacccaatgtccagtcttggatcatagatttaaaaggaaaacccctcttatctaggaggctttaacttcctggaccccaggattcaccttcctagtggtgtttagaaaatgcctccacagcccccttccaccatgggcatgagagctggggtgtgtttcttgagaagctcccttttttcttgctctgctcaccggtgtggcctgggctggagtgcactctccctgggggcagctggggcctcgcaattcttgcttcaggatctctcccatgcgagctgcccggagggtgtcagcagggcaagacacctagtctagagtcaccaaggtcacagtgccactttcacgggatagcaggctcttgggacttttacacaggcctagggtcccctcagtcttggtcccaggagatgggggccactcgtgaggctggccatgctgtggcttctcacagctgtggtctcccctgcctcacaacgactcctttctcttgtgtggcgggactcgcccttttgctgtgctcagaagattcactgaggaaactcatggaagcctctgctcatttgggtcactgggacacccctgagatgggtgtgtttatttgctcagggcgggcagcctatggtgaagaggagacagaggcgatgggcgtgcttcgtcctccgtaacactggctttatttaccgtggtggttcagagtcccaggccctgacctctaaagacttttcataacagacgttaagaccaagccgtggacctcaccccaggggaatgccacggccctttggggacctgcacacccacctctccgggggacttgacaaggggccctgaggccaagggaggtcactcctccctccaggcccctgacttttactttgtggttctctaaaaaccatgtacacactttcactctattgtaaccacacagaagcagaccgtagcccattggccttatgtgcgtgtgtgcgtgcgagtgtgtcactgctggtgggccggagtgatgtggtgggagggaagccgggaatgtatccttttcagacaaaattaaatattttgaaatg

SEQ ID NO: 31654 - DNA, 4386 bp, Homo sapiens
agctggcaggtggccgagccgggggtggacgggcgggctgggactggtgctggccattggctgcctcaaggctcccaccccgcctgcctccctagcctgcggctggcggcccctgcctctccagctgcctctgaactccctggagcaagcacctcctgctgggctgtgtgagctgcgactggttctcagtggcccctgccatggacatgcctgaggtcctcaagtccctgctggagcactctctgccttggccagagaagagaacagataaggaaaaggggaaggaaaagctggaggaggacgaggccgcagccgccagcaccatggctgtctcagcctccctcatgccacccatctgggacaagaccatcccatatgatggcgaatctttccacctggagtacatggacctggatgagttcctgctggagaatggcatccccgccagccccacccacctggcccacaacctgctgctgcctgtagcagagctagaagggaaggagtctgccagctcttccacagcatccccaccatcctcctccactgccatctttcagccctctgaaaccgtgtccagcacagaatcttccctggagaaggagagggagactcccagtcccatcgaccccaattgtgtggaagtggatgtgaacttcaatccggaccccgccgacctggtgctctccagtgtgccaggcggggagctcttcaaccctcggaagcacaagtttgctgaggaggacctgaagccccagcctatgatcaaaaaggccaagaaggtctttgtccccgacgagcagaaggatgaaaagtactggacaagacgcaagaagaacaacgtggcagctaaacggtcacgggatgcccggcgcctgaaagagaatcagatcaccatccgggcagccttcctggagaaggagaacacagccctgcggacggaggtggccgagctacgcaaggaggtgggcaagtgcaagaccatcgtgtccaagtatgagaccaaatacgggcccttgtaacccgtgccccccgcccgggcggggtactgcctgcacctcagacctctgcctgggggctccctgtaacccctcacacgcgtggagacttatgactcgtcgtgggcgcatggcggcgcacctgctgcaggagcggccacgtctcagcttcattataccatggcctgcgcacgtggcgacgtccctgaggggccagtctcctcactggtggggaacgcaagagaatctgcgtagatgggtgactcagccttagtttctattcttggatgtcccagttgaatcagaaggggacctctggagtacacacctctctcctgggcgctcagggtccctggactctccctcagtctccagcctgggctgccgagggctatctctgcagaatgagttgtgatcattgtcaccctatgtcttctcaggtagcagggcgcgtttccacttaaggtgtgtctgtcacgcacctcattctccccagacagtctttgagtaacatctgttcccatcttccttggaagcaggacacaccagctcctccgtcagtgtctgcatgggtagcaggctgcaggagtggggtctctgcacagcctgggatggggcttggggctggggcctgcagcagaagtgtgcccagcgtttctcggctcccgcaccccttttcccttatggctctgaggccatcggctgtctctgcatttcattggctgtggaggagagactcctaggatggctgctgtctgagccatgagtgccagggctgagagaggcctcttcatttcctctccaggctactcagaggccatgtgaagctcgtttgtcccactagaccaggcctctgggcctgctctttctttccacccaatgtccagtcttggatcatagatttaaaaggaaaacccctcttatctaggaggctttaacttcctggaccccaggattcaccttcctagtggtgtttagaaaatgcctccacagcccccttccaccatgggcatgagagctggggtgtgtttcttgagaagctcccttttttcttgctctgctcaccggtgtggcctgggctggagtgcactctccctgggggcagctggggcctcgcaattcttgcttcaggatctctcccatgcgagctgcccggagggtgtcagcagggcaagacacctagtctagagtcaccaaggtcacagtgccactttcacgggatagcaggctcttgggacttttacacaggcctagggtcccctcagtcttggtcccaggagatgggggccactcgtgaggctggccatgctgtggcttctcacagctgtggtctcccctgcctcacaacgactcctttctcttgtgtggcgggactcgcccttttgctgtgctcagaagattcactgaggaaactcatggaagcctctgctcatttgggtcactgggacacccctgagatgggtgtgtttatttgctcagggcgggcagcctatggtgaagaggagacagaggcgatgggcgtgcttcgtcctccgtaacactggctttatttaccgtggtggttcagagtcccaggccctgacctctaaagacttttcataacagacgttaagaccaagccgtggacctcaccccaggggaatgccacggccctttggggacctgcacacccacctctccgggggacttgacaaggggccctgaggccaagggaggtcactcctccctccaggcccctgacttttactttgtggttctctaaaaaccatgtacacactttcactctattgtaaccacacagggcaggcgcatccagcatgtcagtgtcctgccccgggcagctctccctcccgggcacgctccctctggcctggtggatcaccaagagggcggttctcattttgttattagtggaagagccttgagcttaaaagctcttcattttctttgccggaaagtatatggtttgtgtttttgcagttttatttttttaaggatggacactaaatctctggtgtccatgttccgagcccggtggctgggatggtggctcgatgtgtctcctctttatcccgccctctgcctgtttggtgccctcccttctttcccccaggcagtgggtatcgggttctttcccaaagtgcttacttggaaagagtgtggctgctggactcttttcgaaatgcccctctgagtcaggagcctggtggggacaagatggaggatgtccacagaggctgacctgtgggggaaaagaagtgctcaggtaaggttgtctcctctcctgtcctaaaaaaatccatgcttgcaggagagggttggtgcctgctcagtttctgtcgagggaatgggagtctcctcggctccctcctgggccctctgcttcttggaggccgaccgctggagactgcggctcctgtgcttggatctttgacatctgtcagtcactggaggctagagaagttgactttaccttggctttctgtgggttcccgatgggcttggaagtgccgtctacttcctaagcatcctgtctaaagctttgtggcaccctcagtgcaacctcagaacagacaaatcatgaatgagctggaactttgcaagaatattcatattataaatgtctcatctgatggaggaacgtgtgcatttagagagagggagagttttcaaggtttatggcaactttgtggaggacctgggtaactcttacccttggccaaaggaagaggttttcctgtctggcttctgaggttggagggggcacttagcagtgaaccttaagtctgggtacatgtaaccctgctgaggggctgtgcaggccgctcctacggtcctttggcctgaggcagggcgggaggcatgcaagccagtgggggaaaacccctctgaagctgggcagccctctacctgggccccgggagccgtgctccttggaacgcaaagggccgaggagcatctggttttcatggcaaagctctactccagagctcctttaacatctgctaattaagtgcaataaatttttctagaaaatggcaaagatgacttccaggtggatattgctctcttacggtgttggggatgccagaacaccacttggttttatttttctaagtgcatgtgatgtgatagagtgtgtggggctctgtgtccttccctgggagctggcattccagcgggcccctctctttacctttgttgggggaaggaggcaagagagaaattccttcttcccagccagagagggcagaagcagaccgtagcccattggccttatgtgcgtgtgtgcgtgcgagtgtgtcactgctggtgggccggagtgatgtggtgggagggaagccgggaatgtatccttttcagacaaaattaaatattttgaaatgag

SEQ ID NO: 31655 - DNA, 1978 bp, Homo sapiens
tctgcggccgtgtccctttcgtgtgtgtctgccctgtgtttctccgtcgtctccgtgtggatctcggtctttgtctcgccctctagctctctcgtgcgcctgtgtttaatcgtgcgcttctctcaatctctctgtccctccctttgccccctacacgcgtgttctcgtcaacagatctccagaggtggtgcagaaacgaccccgcgccggcgccccatcctgcggccagtgcctccgcgccccggctccggtccccaccgtccccgccccagatttccggaggagcaggcgggcggggtcccgcggggccggctgccgtcagcgccccttcccggcggccgcgacccctccccgctgacctcactcgagccgccgcctggcgcagatataagcggcggcccatctgaagagggctcggcaggcgcccggggtcctcagcgctgcagactcctgacctgccgactgcggatcccgagtccccggatcccggacccatcctgtggagcccactcctggcagacgccgcgatgcccggcccttggttgctgctcgctctggctttgaccctgaacctgaccggtgtccccggcggccgtgctcagccagaggcggcccagcaggaggcagtgacggccgcggagcatccgggcctggatgacttcctgcgccaggtggagcgcctcctcttcctccgggaaaacatccagcggctgcaaggggaccagggtgagcactccgcgtcccagatctttcaatctgactggctctccaaacgtcagcatccaggcaaaagagaggaggaggaggaagagggagttgaagaagaggaagaggaagaagggggggctgtgggaccccacaaacggcagcaccctggccgacgagaagatgaggcttcatggtcagtcgatgtaacccagcacaagcggcagcatcctggccggcgctccccctggcttgcatatgctgtcccgaagcggcagcacccaggcagaaggctggcagatcccaaggctcaaaggagctgggaagaagaggaggaggaggaagagagagaggaagacctgatgcctgaaaaacgccagcatccgggcaagagggccctgggaggcccctgtgggccccagggagcctatggtcaagcgggccttctgctggggctcctggatgacctgagtaggagccagggagctgaggaaaagcggcagcaccctggtcggcgggcagcctgggtcagagagcccctggaggagtgaacccagttttccctgaagtcgagtttgtggtctaaggatgtcttgagccctgtgtgccccaccattcatgacctctgtattctctagttagatccctgaccataagcctgagcccctccctcccagccccatattcacacacatcccagcccctggccttgccctcttcctttaggcatgtgagaaaatcagcctagcagtttaaaccccactttcctccacttagcaccataggcaagggggcagatcccagagcccctctcaccccccccaccacaggcctgctccttccttagccttggctaagatggtccttctgtgtcttgcaaagactccccaagtgggacagggagcccctgggagggcagccagtgagggtggggtgggactgaagcgttgtgtgcaaatccagcttccatcccctccccaacctggcaggattctccatgtgtaaacttcacccccaggacccaggatcttctcctttctgggcatccctttgtgggtgggcagagccctgacccacagctgtgttactgcttggagaagcatatgtaggggcataccctgtggtgttgtgctgtgtctggctgtgggataaatgtgtgtgggaatattgaaacatcgcctaggaattgtggtttgtatataaccctctaagcccctatcccttgtcgatgacagtcatcctaatgataataaaacctgcatccagataatca

SEQ ID NO: 31656 - DNA, 5618 bp, Homo sapiens
aagaaaaagaagaagaaaaagaagaggaagaagaagaaggaggaggaggaggaggaggagggggccgagaagagcagctcacccttcgcagccgcgatgggggaagacgacgccgcgcttcgggctggcagcagggggctctccgacccgtgggcagactcagtgggagtgcgaccccgcaccacggagcgccacatcgccgtacacaagcggcttgtgctggccttcgctgtgtccctcgtggcattgctcgcggtcacaatgctcgctgtgctgctcagcctgcgcttcgacgagtgcggggcgagtgccacgccaggcgccgacggtggcccctcaggctttccggagcgcggcggcaacgggagcctccctggatcggcccggcgcaaccaccacgcaggcggggactcctggcagcccgaggcgggtggggtggccagtccggggaccacgtcggcccagccgccgtcggaggaggagcgggagccgtgggagccgtggacgcagctgcgcctgtcgggccacctgaagccgctgcactacaatctgatgctcaccgccttcatggagaacttcaccttctccggggaggtcaacgtggagatcgcgtgccggaacgccacccgctacgtagtgctgcacgcttcccgagtggcggtggagaaagtgcagctggccgaggaccgggcgttcggggctgtccctgtagccggttttttcctctacccgcaaacccaggtcttagtggtggtgctgaataggacactggacgcgcagaggaattacaatctgaagattatctacaacgcgctcatcgagaatgagctcctgggcttcttccgcagctcctatgtgctccacggggagagaagattccttggtgttactcagttttcgcctacacatgccagaaaggcatttccttgttttgatgagccaatctacaaggctactttcaaaatcagcatcaagcatcaagcaacctatttatctttatctaatatgccagtggaaacttccgtgtttgaggaagatggatgggttacggatcacttttcacagacccctctcatgtccacatattatttagcctgggcaatttgcaacttcacatacagagaaactaccaccaagagtggggttgtagtacgattatatgcaagacctgatgctatcagaagaggatccggggactatgctctccatataacaaagagattaatagaattttatgaagactactttaaagtgccctattccttgccaaaactagatcttttagctgtgcctaagcatccgtatgctgctatggagaactggggactaagtatttttgtggaacaaagaatactgctggatcccagtgtttcatctatttcttatttgctggatgtcaccatggtcattgttcatgagatatgtcaccagtggtttggtgaccttgtgacgcctgtgtggtgggaagacgtgtggctgaaggaagggtttgctcactactttgaatttgttggtacagactacctctatcctggctggaacatggaaaagcagaggtttctgaccgatgttctgcatgaagtgatgctgctggacggtttggccagttcccatccagtatcacaggaagtgctgcaggcaacagatattgacagggtgtttgactggatcgcatataaaaagggtgctgctttaataagaatgctggctaattttatgggccattcagttttccagaggggtttgcaagattatttaaccattcataagtatggtaatgcagccagaaatgatctctggaatacattatcggaggctttaaaaagaaatgggaaatatgtaaatatacaagaagtaatggatcagtggacactccagatgggttatcctgttatcaccatcttgggaaacacaacagcagaaaatagaataataattacccaacagcattttatctatgatatcagtgctaaaactaaagcacttaaacttcagaataacagttacctgtggcagattccattaactattgtggtaggaaatagaagccatgtgtcttcagaagcaattatttgggtgtctaacaaatcagagcaccacagaataacttatttggacaaaggaagctggctgctggggaacatcaatcaaactggctattttagagtcaactatgacctaaggaactggagattattaattgatcaattaatccggaatcatgaggttctttctgtcagtaaccgagcgggcttgatcgatgatgccttcagcctagccagggctggctatttgcctcagaatattcctctggagattatcagatacctgtctgaggagaaggattttcttccttggcatgctgccagccgagctctttatcctctagataaattactggaccgcatggaaaactacaacattttcaatgaatatattttaaagcaagttgcaacaacatatatcaagcttgggtggccgaaaaataattttaatggatctcttgttcaagcatcctaccaacatgaagaactacgtagagaagttataatgctggcctgcagttttggcaacaagcactgtcaccaacaggcatcaacacttatttcagattggatttccagcaacaggaacagaataccactaaatgttagagacatcgtatactgtacaggagtgtcactactggatgaggatgtctgggaattcatatggatgaaattccattccaccacagcagtttctgagaagaaaatattattggaagccttaacttgcagtgatgacaggaatttattaaacaggcttctaaatctgtcactgaattctgaggtggtgctggatcaagatgcaattgatgtcataatccatgtagctcgaaatccacatggtcgagaccttgcctggaagtttttcagggataaatggaagatattaaataccaggtatggagaagcattgtttatgaattccaaactcatcagtggtgtcacagaatttcttaatactgaaggtgaactcaaagagctcaagaacttcatgaaaaactatgatggggtagctgctgcttctttctcacgagctgtggaaactgtcgaagccaatgtgcgctggaaaatgctttaccaagacgagcttttccaatggttaggaaaagctctaagacactaatatatgtatcttataaacaaacaattcaactcagaagtttatgagaagacacgctttttgtggaatgaggaaaatgtactacctagaaaatggccagattttcagtgttaacgtgtgggaggaattttttttttagtttttattttttggttttgggggatattttttatttgtttcattcattctgttctgtttctctactgggtgttcctctctaaagaaactcttgcaagtgaaactagccatgattgcttcagctgtacattccttgctgtacaggaccaaatatgatagtgatgcatgttgatgttacagtcaatttggaaaaacatattcagaatatctgtgcatggatatattgtcctgcctgtgttccagcatgcttatttcaaacgtccagtgttgtgtgtgaatatgtgttacacctaggatgggcattatgcaaaagcacaaagattatatatgacaatcagtattgcaatgaaagaaaaactaaaaacagaaatgatattctcaattttgggcaatgtgagaggtaaaatagcccttgacatgatgaacatcacttatttcagcacttggattgtctggcaatgattactgtgttgctaactcattttctttgagttaaagctgtgtatacattttaaaaggcatatagatagtgtatgcatatgtatatgtacatagggaagccccatatgtatatagtatgttgtacactgcacatgtacaaagaatgtcttcagatcaaagaaaatttatctctttttataaacttaaggacagttgcaaaaggcttcaaggaatttatctcaacattattctttctatgtcctaactaaatttctcaactgttatgaatttttcatctacttcttgaacagtggtctattctgctacatgaagatgaatacaaacaaaatttttgtataaactactattccagttctcctgtgtcagtcttgcctatagattttgccatcgttttctgtcaaagttccttttgcatgaaacaattatgcaaacttataattattagtgctgaaaaagagtttattttccatcttgtttgttttcctaccttatgctgagtagtccagagagttaaaaaaattctctgcatgttggtcttttaagtctgttttgctctaatcctccattaagcgagcatacctcaagtgggtctattagcatttaatgaccttttgtgccagttgtgccatcccttaagatgaaaagttccttttcttgtgttaatgtacaaagcttttcttttggcactgacaactgtgttctacctgggaattttgaatagccattttcatggctgtgtgttgtgtaacacaaatgtttttaaatggtattctcacccagtaggccagctctccaaacgttgcttagatgcttcaaaattagcatattttaagtttaccagtataaaataccaatgcaactactctacatagccaaatgtttgtaaatcacgtcttattttcctgaggtttttcactccaccaaatcttacaaatcattgaaagaaatatattctaacagtacgcactgaatagtgaaaataattagacattttaagaaccagagccatagaattattttaaattagtagaaaagaggagctatttccgaatctatagaataaagtaccacctaaaactgaattttatcatataagcaagtaatacctattagtcatacctaaatttttcagcacttcattcaattaaaatacatgaattttaaatattttacatgatgtgaataggcatgataatacttttagtataaaatctaaactttttccatttatcagaaatgataaaatccagttaccacatatcacgtttataaaatccttaattaaatgagtaacttctaaaatataacaatactaaatatcacactgcgatggaggtcccaaatatgtggtctatcaccactgaattcatgtaatagataagaaaaaaattagaggtggatgtcttgttttgtgtcatgaattactaaaatctcttagtagttgtggtatatttttgagtaaaattaccatttccagatttgagtttgaagggcttttatagttgtattttcctcctcactgttaataatcataatcctttttcagtattttagtggccttgaacaactggtttatctacaatctcaaatcctaagtgtataattatgtgcaatgttcaatacctcatataatacttgctcaacagtatagtggtaccaatggcattaagatggtgtttttgttctacatatttttcaataatttattctttctaatgttgaaattatatcaggctttaccggtttttttagttgtttaaataagtaatattttcaaaagaataaaataaccaatgatatctcttggaataatctgtaaaacgtagttataaaattctattttctactta

SEQ ID NO: 31657 - DNA, 1415 bp, Homo sapiens
gggggatggaactgctgcaataaaggtgggcgctggaaagaagatgttttgagaagtcagtgtttccgagaaactttaagcttctaaagatggaaaacgagacagtcagtgaactgaaccaaacacagcttcagccacgagcagtggtggccttagaataccaggtggtcaccatcttacttgtactcattatttgtggcctgggcattgtaggcaacatcatggtagtcctggttgtcatgagaaccaagcacatgaggacccccacaaactgctacctggtgagcctggcagtagctgatctcatggtcttggtggccgcaggcctccccaacataacagacagtatctacggttcctgggtctatggctatgttggatgcctctgcattacttacctccagtatttgggaattaatgcatcctcttgttcaataacagcctttaccattgagaggtacatagcaatctgtcaccccatcaaagcccagtttctctgcacattttccagagccaaaaagattatcatctttgtctgggctttcacatctctttactgtatgctctggttcttcttgctggatctcaatattagcacctacaaagatgctattgtgatatcctgtggctacaagatctccaggaattactactcacctatttacctaatggactttggtgtcttttatgttgtgccaatgatcctggctaccgtcctctatggattcatagctagaatccttttcttaaatcccattccttcagatcctaaagaaaactctaagacatggaaaaatgattcaacccatcagaacacaaatctgaatgtaaatacctctaatagatgtttcaacagcacagtatcttcaaggaagcaggtcaccaagatgctggcagtggttgtaattctgtttgcccttttatggatgccctacaggactctagtggttgtcaactcatttctctccagtcctttccaagaaaattggtttttgctcttttgcagaatttgcatttatctcaacagtgccatcaacccggtgatttacaatctcatgtcccagaaattccgtgcagccttcagaaagctctgcaactgcaagcagaagccaacagagaaacctgctaactacagtgtggccctaaattacagcgtcatcaaggagtcagaccatttcagcacagagcttgatgatatcactgtcactgacacttacctgtctgccacaaaagtgtcttttgatgacacctgcttggcttctgaggtatcctttagccaaagttgattcatgaattagaagaaaatggatgacaaagaaaatgagaatctgtgcagtcatcaacaaaagggagaacatggccaatagtcatatgtgaagacagagcagatcagtctttgtcaatgctctaacaaa

SEQ ID NO: 31658 - DNA, 1660 bp, Homo sapiens
tgttctcattaggggacgatctatgatttgacagcctcactgctgctgctcctgctgctgcttctgcttctgccgcggctgtatggtttgtcattagttggaaagggctgtgagggtttggagaaactgcagttttaaagactgagcactgctaagtggtctccctctcaaatagagtagacaagattttctgcaagattagaaacttggaactattaccacttcatctacccagaaaatcaggcagcgctacagaggataagggggatggaactgctgcaataaaggtgggcgctggaaagaagatgttttgagaagtcagtgtttccgagaaactttaagcttctaaagatggaaaacgagacagtcagtgaactgaaccaaacacagcttcagccacgagcagtggtggccttagaataccaggtggtcaccatcttacttgtactcattatttgtggcctgggcattgtaggcaacatcatggtagtcctggttgtcatgagaaccaagcacatgaggacccccacaaactgctacctggtgagcctggcagtagctgatctcatggtcttggtggccgcaggcctccccaacataacagacagtatctacggttcctgggtctatggctatgttggatgcctctgcattacttacctccagtatttgggaattaatgcatcctcttgttcaataacagcctttaccattgagaggtacatagcaatctgtcaccccatcaaagcccagtttctctgcacattttccagagccaaaaagattatcatctttgtctgggctttcacatctctttactgtatgctctggttcttcttgctggatctcaatattagcacctacaaagatgctattgtgatatcctgtggctacaagatctccaggaattactactcacctatttacctaatggactttggtgtcttttatgttgtgccaatgatcctggctaccgtcctctatggattcatagctagaatccttttcttaaatcccattccttcagatcctaaagaaaactctaagacatggaaaaatgattcaacccatcagaacacaaatctgaatgtaaatacctctaatagatgtttcaacagcacagtatcttcaaggaagcaggtcaccaagatgctggcagtggttgtaattctgtttgcccttttatggatgccctacaggactctagtggttgtcaactcatttctctccagtcctttccaagaaaattggtttttgctcttttgcagaatttgcatttatctcaacagtgccatcaacccggtgatttacaatctcatgtcccagaaattccgtgcagccttcagaaagctctgcaactgcaagcagaagccaacagagaaacctgctaactacagtgtggccctaaattacagcgtcatcaaggagtcagaccatttcagcacagagcttgatgatatcactgtcactgacacttacctgtctgccacaaaagtgtcttttgatgacacctgcttggcttctgaggtatcctttagccaaagttgattcatgaattagaagaaaatggatgacaaagaaaatgagaatctgtgcagtcatcaacaaaagggagaacatggccaatagtcatatgtgaagacagagcagatcagtcttt

SEQ ID NO: 31659 - DNA, 4633 bp, Homo sapiens
aactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcaatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 31660 - DNA, 4647 bp, Homo sapiens
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 31661 - DNA, 4770 bp, Homo sapiens
gctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 31662 - DNA, 490 bp, Homo sapiens
ttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcgtaagtatcataatcagtactacactcagtcatgataggcagaattgtatatgattaacttgtaattgaattaagattttctttctctagttagtatggttttgttttgtttcttatttttcatttatttattttggtttgttttgagtagtggatgttgttgaaaatgttaatgtcatttcagtgtct

SEQ ID NO: 31663 - DNA, 2317 bp, Homo sapiens
tcttcacgtcccagcgcgggtgggcgccggcggctcctcttaaccacaggttccagaagtcctctgcagaagtgcttccctctctcatttccaggaccacaattcccagagacttcggcttcacgacgtttctctttttgcccgatctctcccggagctggctgggcttcggccggccagaggcccacagcgacgacgtgatccgtcgtgagcgggtcccagggtttcctcggcggcccttttttctctcccctcggtcgtcccccttgcaggctgtcgcggctggcctgagcggtgacctggcgggtcgcgcctgcgctctgccctgtttcctgcctggctggtggcggcggccattttgttcatcctcctcctcctcctgctcctcctggttggagcgcagtgtccggagcgggctggggggagagagcccgagagcagggttcggtgccttttcctctgtccccagccggtgcccagagcccccctccccttcctccccaccccctcccctccccaaccctgccctcccccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcaattgctcataagaatggacaggatcttgaaggctaactgcaaggaactgtgcacactggaactcagttgtagattttttttctcatttctatttattcttattatacattatttatatatacatattttagtatttacattttaacattctatattcagtggagttctatatttccaatcatttaacttactcactaaaatttctgtgtaaatttgttgttttcgtactggtgtgcttagcattgttgttagttttttattctcctttcttaaatttctgaaaatgtcaatttttcaaaatttacagctgcccaaactccaaaatgatggtagagaattgaccaagaaaaataaagaaatctgttaacaggccatggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaag

SEQ ID NO: 31664 - DNA, 2187 bp, Homo sapiens
ttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcaacccgatagcagaagggtcaactcttctgttggattttctgttttgcagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaa

SEQ ID NO: 31665 - DNA, 515 bp, Homo sapiens
aaaaaagaaagaaagaaagaaagaaagaaaagatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattg

SEQ ID NO: 31666 - DNA, 1401 bp, Homo sapiens
accctgccctcccccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaa

SEQ ID NO: 31667 - DNA, 2448 bp, Homo sapiens
agttctgcctctgtccaggtccttgtgacccgcccgctctcctaagggagcgtgtcctggccccctcccgcagcggctcggaaaaaaggcagcaccgcgtcgttgacggcgcgggctctggactcgctgcttggtaaaaaccttcctcttcctccagtgcgggacgcactctctggtatctcttttgacctcccggaggctttcctttgtcggtcgcggcgccactgtactatggcatacctcgttttattacgcttcgcagatagggcattctgaaaacaaatggagggtttgtggcagccctgagtccagcaattgtatcagcgccatttttccaacagcatgtgctcacttggtgtctctgtgttacattttggtaattctcaaaatatttaaaactttttcatgatttctgtgtctgttatggtgatctatgatcagtgatctttgatgttgctattgtcattgttttggggtgccacatacagcgtcttttataagacgtggaacttaatgttgtgtgtgttctgaccgctccacccacagaccgttccccatctctctccctcttcttgggcctccctattccctgagacacaacaatattgagattaggcgaattaatgactctgcaatggcctctaagtgctcaagtgaaaggaagagtcgcacatctctcactttaaatcaaaaactagaaatgattaaactgagtgaggaaggtatgtcaaaagccgagataggccgaaggctaggcctcctgcggcaaacagttagccaagttgtaaatgcaaaggaaaagttcttgaaggaagttaaaagtgctactccaatgaacacacgaatgataagaaagcgaaacagccttattgctgatatggagaaggttttagtggtctggatagaagatcagaccagccgcaacattcccttaagccaaagcctaatccagaacaaagccctaactctcttcaactctatgaaagctgagagaggtgtggaagctgcagaagaaaagtttgaagctagcagaggttggttcatgaggtttaaggaaagaagccatttccataacataaaagcacaaggtgaagcagcaagtgctgatgtagaagctgcagcaagttatccagaagctttagctaagatcattgacgaaggtggctacactaaacaacagattttcaatgtagatgaaacagccttctattggaagaagatgccatctagaactttcatagctagagaggagaagtcagtgcctggcttcaaagcttcaaaggacaggctgactctcttgttaggggctaatgcagctggtgactttaagttgaagccaatgcttatttaccattctgaaaatcctagggcccttaagaattatactaaatctactctacccgtgctatataaatggaacagcaaagcccggatgacagcacatctgtttacagcgtggtttactgaatattttaaacccactgttgagacctactgctcagaaaagaagattcctttcaaaatattactgctcattgacaatgcccctagtcatccaagagctctgatggagatatacgaggagattaatgttattttcatgcctgctaacacaacatccattctgcagcccatggatcaaggggtaatttcgaccttcaagtcttattatttgagaaatacatttcataaggctctagctgccatggatagtgatgtctctgatggatctgggcaaagcaaattgaaaaccttctggaaaggattcaccattttagatgccattaaaaacattcgtgattcatgggaggaggtcaaattgtcaacattaacaggagtttggaagaagttgattcccaccctcattgatgactatgaggggttcaagacttcagtggaggaagtaagtgcagatgtggtggaaatagcaaaagaactagaattagaagtagagcctgaagatgtaactgaattgctgcaatctcatgataaaactttaacagatgaggagttgtttcttatggatgcgcaaagaaagtggtttcttgagatggaatctacacctggtgaagatgctgtgaacattgttgaaatgacaacaaaggatttagaatattacataaacttagttgataaagcagcagcagggtttgagaggattgactccaattttgaaagaagctctactgtgggcaaaatgctatcaaacagcatcgcatgctacagagaaatctttcatgaaaggaagagtcaactcatgcgaaaagcttcaccgatgtcttattttaggaaattgccacagccaccccaaccttcagcagccaccaccctgaccagtcagcaaccatcaacctcgaggcaagaccctccaccagcaaaaagagtacgactcaccgaaggctcagattgataatcagcattttttagcaataaagtatttttaaattt

SEQ ID NO: 31668 - DNA, 2083 bp, Homo sapiens
gattcacgtagaccttgtcaggaaattggtcactatccatctaggccctagaagtgagaggaggaatcttacgaactcattttctagttgctttgtattcaaatcttagttgttaattatcttgttctagtaatcacctaaaatattagacacttaaaatgttggggaaacgtaagcgtgtggtgttgacaattaaggacaagcttgacattattaagaaacttgaggaaggcatctctttcaaaaaactttccgtggtgtacggaattggtgaatccacagttcgtgatattaaaaagaacaaagaaaggattataaactatgcaaacagttcagatcctaccagtggagtatccaaacgtaaatctatgaagtcatcaacatacgaggagcttgatagagttatgatagagtggtttaaccaacagaaaacagatgggattccagtgtccggaacgatttgtgcaaaacaagccaagttcttttttgatgctttgggaatggaaggtgattttaatgcatcgtcaggctggctaactcgatttaagcagcgccatggtattccaaaggctgctggtaaaggaacaaaattaaaaggagatgaaactgctgccagagaattttgtggtagctttcaggaatttgttgaaaaagagaatctacaaccagagcaaatttatggtgctgatcaaactggattgttttggaaatgtctaccatcaaggacattaactcttgaaactgaccaaagtacttctgggtgtaggtcaagcagagagagaatcatcattatgtgttgcgcaaatgccacaggtttacacaaacttaatctttgtgttgtggggaaggccaaaaagccccgagcattcaaaggcactgacctttcaaaccttcctgtgacatattacagtcaaaaaggtgcatggatagaacagtctgttttcagacagtggtttgaaaagtactttgtgccacaggtacagaagcatttgaaatccaagggacttttagaaaaagcagtgcttcttttagatttccccccagcacgtccaaatgaagaaatgttgagttcagatgatggcagaataattgtgaagtatttgccaccaaatgtcacaagtctgattcaaccaatgagccagggagttctagccactgtaaaaagatactatcgagcaggacttctccagaaatacatggatgaaggaaatgacccaaaaatattttggaagaacttgacagtgttggatgcaatttatgaagtgtcaagagcttggaacatggtaaaatcaagtaccataaccaaagcatggaaaaaacttttccctggcaatgaagagaattcaggtatgaacattgatgaaggagccattttagcagctaatttagcaacagttttacagaacacagaagaatgtgaacatgttgacattgagaatattgatcagtggttcgactctcggagcagtgactcaagctgtcaggtgctgactgacagtgaaagtgctgaggaccagaccaaggctgctgagcaaaagccttccagtaagagtagaaaaacagaactgaatccagagaagcatattagccataaagcggcacttgaatggactgaaaatttactggattatcttgaacaacaagatgacatgcttctgtctgataaattggtattaaggaggcttcggaccataataagaaaaaaacagaagatccaaaataacaaaaatcattaataaggctcttaagtatttcagtgtatctgcatctttgtgactatctgcagtgaaactttgcttgtttgaagtcctgtggattccaaagccaaatacattttataaatgattttggaattagatgtcagtttggattacttaaattacaactctttaatgttgactctagtcattgggcattgacgtgtaacttgtctttctactgtttctaatatctattaattagatcataaggtacctgaggccagggatcttgtgtctgttgtgcctgaatttggcgtgtctaataaaggcccatgcacactataggcactcaataaaacttacatttttatgatttttctttg

SEQ ID NO: 31669 - DNA, 1650 bp, Homo sapiens
atgaataagagagggaaatatacaacactgaatttggaggagaaaatgaaggttctaagtagaattgaagctggacgatcacttaaaagtgtaatggatgaatttggaatcagtaagtcaacattttatgacattaaaaaaaataagaagttaattctggactttgtactgaagcaggacatgccattagtaggggctgagaagagaaagaggacaacgggagccaaatatggtgatgtagatgatgcggtctacatgtggtaccaacagaaacgctcagccggtgttccggtaagaggcgtggagcttcaggctgctgcagagagatttgcacggtgttttgggcgaacagatttcaaagctagcactggttggctttttagatttcgaaatcggcatgcaattgggaaccgaaaaggatgtggggaacaagtcctaagttcagtttctgaaaatgttgagccatttcgacaaaaactgtccatgataatcaaagaggagaaactgtgtctagctcagctatacagtggggatgaaacagacctcttttggaagtcaatgccagaaaattctcaggcaagtaggaaagatatctgcctaccagggaagaaaataaacaaagaaaggttgtctgcctttttatgtgcaaatgcagacggaactcataaattaaagtcaatcattattggaaaatcaaaactgcccaaaagtgtgaaagaggacacaagtacattgcctgtgatatataaacccagtaaagatgtttggttcaccagagaattgttttcagaatggttttttcaaaactttgttcctgaggtccgacattttcaacttaatgttctaagatttcatgacgaggacgtcagggcattgttacttctggacagttgcccggctcatccttcctctgaatccctaaccagtgaggatggtcgaataaaatgtatgttcttcccccataacacttcaaccttgattcaaccaatgaatcaaggtgtgatcttgagctgcaaacggctgtatagatggaagcaacttgaagagagtcttgtaatatttgaagaaagtgatgatgagcaagagaaaggagataaaggagtttccaaaattaaaatctacaatataaaaagtgcaatttttaactgggcaaaaagttgggaagaagtaaaacaaataaccatagcaaatgcatgggaaaatcttctttacaaaaaggaacctgaatatgattttcaaggcttagaacatggggattatagagaaattcttgaaaaatgtggggagttggaaactaagttggatgatgatagggtgtggttaaatggagatgaagaaaagggttgtctcctaaaaaccaaaggtggaataacaaaggaagttgttcaaaaaggaggagaagctgagaagcagactgctgaatttaaattatctgctgtaagagagagtttggactaccttcttgactttgttgatgccacacctgagtttcagagattccacttcacactgaaagagatgcaacaagaaatagtcaagaaacagttccagagtaaaatccattctagaattggtagctttttgaaacctaggcctcataatattaaggactccttcagtgggccttcaacttctggttctaatcattag

SEQ ID NO: 31670 - DNA, 3612 bp, Homo sapiens
acctcggccagcttggcttccgtggaggccgctcctcgctttctgaggctcaaacgcaagccaccgcccgaaaggccgccgatctgaggagcgcaaccgccagcccaccgctggcctaccgcagccctgtccaggtacagagccagagcgccggccggaagtggaagtgacgctttccgagggtggcgcaggcccgccctctggctaaggcgcctgagcccggcctacttcctcgccagagaaactgctgtcttccccggcggtagggaagggttaatgccaccgagtatccagacccgctgaagcctagagggccttgtaccggctcaccgcgtggctgtcgctgtctcgtgtccccagtgggggaggcgtcgcactgccgcgtctgttctgcgtggctgtcgggcggcgtttggtcccgggagcctcgccggcacctggaatggataaaagtggcagtttttgtttcttcccatgaggttgtgtatctggactgagaaccaggaaattaatctagactaagacatttctaaggacctggaatggctttggggagcaccaggaggacccgaaaagagtatttgagggcctagagggacagaagagtttgccagtaggatttatgagaaacaattgatcagaaacagcagcagagaaaccttttagatttcttctgtggaaaagttgagtcttggttcaaattaagtaaaataaacactgaagagaaatcaaaatctcaaatataaaaagtatgttacttatagtgtaaatttaggaaaacaaatgaaaggacagatctttaaaaatttttaactatggtgaaatatttgtaaaacttttgggctcatctctgagaattgctgtgattctgaaacttgataatatctcaaatagagaacagtttcagtgaaaaatagcacttgagaataaatcagatgttcccaagaaagaagatctgagaatggtaaagtgccactgacaaataaattatttacatacttacatattaccttggcaaacacaagagacattcaagttaaagcacggtgcttgacaatactatattgaatgcaataaaagttggatttcattcatatgtacaacaaactactttcttcttcacttcaagattcggtacaactgttcctgaattccaactctccatacatcccaatgtcagggtccctgtagctcggagcccttatccaggtagatgaactgctgcccagtgaacactatgtacaaagcaatttgagcaccattctcttttctggcagtgaggtaaaatcaggtctttttggaaggggagaagccacattgcatctctgctacacacaagattactctgtcattgcctttgagtctttcacgctcccttcttctgaagcatcagtttttatggaaacttatcacacctgtcttgtgggcacatcttgctccatccctcctctcttcatattgtccgttttccggtattgagttagggaaagtatgcaggtattcctgtcattcctgactgaggctgttgtatctgtcaaaagagaggagaggtagggggcattctgaaaaatgatcactcatggcttgcaggagcaagagccagacaggactttgcaactggcagctttctgagtgcataagacctccacctctagactagctcttcagtcatggttagccccttcagtccattatcctccaatacaatgcccatgccttctggggctttcagctaagttttgtttaaaaaatgtgggttttttttttgccaattcattaaggcttttccctttgttttctcctgttggtggttcagagttaaattcagtatgaataagagagggaaatatacaacactgaatttggaggagaaaatgaaggttctaagtagaattgaagctggacgatcacttaaaagtgtaatggatgaatttggaatcagtaagtcaacattttatgacattaaaaaaaataagaagttaattctggactttgtactgaagcaggacatgccattagtaggggctgagaagagaaagaggacaacgggagccaaatatggtgatgtagatgatgcggtctacatgtggtaccaacagaaacgctcagccggtgttccggtaagaggcgtggagcttcaggctgctgcagagagatttgcacggtgttttgggcgaacagatttcaaagctagcactggttggctttttagatttcgaaatcggcatgcaattgggaaccgaaaaggatgtggggaacaagtcctaagttcagtttctgaaaatgttgagccatttcgacaaaaactgtccatgataatcaaagaggagaaactgtgtctagctcagctatacagtggggatgaaacagacctcttttggaagtcaatgccagaaaattctcaggcaagtaggaaagatatctgcctaccagggaagaaaataaacaaagaaaggttgtctgcctttttatgtgcaaatgcagacggaactcataaattaaagtcaatcattattggaaaatcaaaactgcccaaaagtgtgaaagaggacacaagtacattgcctgtgatatataaacccagtaaagatgtttggttcaccagagaattgttttcagaatggttttttcaaaactttgttcctgaggtccgacattttcaacttaatgttctaagatttcatgacgaggacgtcagggcattgttacttctggacagttgcccggctcatccttcctctgaatccctaaccagtgaggatggtcgaataaaatgtatgttcttcccccataacacttcaaccttgattcaaccaatgaatcaaggtgtgatcttgagctgcaaacggctgtatagatggaagcaacttgaagagagtcttgtaatatttgaagaaagtgatgatgagcaagagaaaggagataaaggagtttccaaaattaaaatctacaatataaaaagtgcaatttttaactgggcaaaaagttgggaagaagtaaaacaaataaccatagcaaatgcatgggaaaatcttctttacaaaaaggaacctgaatatgattttcaaggcttagaacatggggattatagagaaattcttgaaaaatgtggggagttggaaactaagttggatgatgatagggtgtggttaaatggagatgaagaaaagggttgtctcctaaaaaccaaaggtggaataacaaaggaagttgttcaaaaaggaggagaagctgagaagcagactgctgaatttaaattatctgctgtaagagagagtttggactaccttcttgactttgttgatgccacacctgagtttcagagattccacttcacactgaaagagatgcaacaagaaatagtcaagaaacagttccagagtaaaatccattctagaattggtagctttttgaaacctaggcctcataatattaaggactccttcagtgggccttcaacttctggttctaatcattagattttgtgtttaaagatttctgccattatatgatgtaggccagctgtgaattgtcttgttttagcaactgacattattttgtatatcagtgcccatttatataatggttataaaatttacagtttgaaaataa

SEQ ID NO: 31671 - DNA, 1536 bp, Homo sapiens
atgaataagagagggaaatatacaacactgaatttggaggagaaaatgaaggttctaagtagaattgaagctggacgatcacttaaaagtgtaatggatgaatttggaatcagtaagtcaacattttatgacattaaaaaaaataagaagttaattctggactttgtactgaagcaggacatgccattagtaggggctgagaagagaaagaggacaacgggagccaaatatggtgatgtagatgatgcggtctacatgtggtaccaacagaaacgctcagccggtgttccggtaagaggcgtggagcttcaggctgctgcagagagatttgcacggtgttttgggcgaacagatttcaaagctagcactggttggctttttagatttcgaaatcggcatgcaattgggaaccgaaaaggatgtggggaacaagtcctaagttcagtttctgaaaatgttgagccatttcgacaaaaactgtccatgataatcaaagaggagaaactgtgtctagctcagctatacagtggggatgaaacagacctcttttggaagtcaatgccagaaaattctcaggcaagtaggaaagatatctgcctaccagggaagaaaataaacaaagaaaggttgtctgcctttttatgtgcaaatgcagacggaactcataaattaaagtcaatcattattggaaaatcaaaactgcccaaaagtgtgaaagaggacacaagtacattgcctgtgatatataaacccagtaaagatgtttggttcaccagagaattgttttcagaatggttttttcaaaactttgttcctgaggtccgacattttcaacttaatgttctaagatttcatgacgaggacgtcagggcattgttacttctggacagttgcccggctcatccttcctctgaatccctaaccagtgaggatggtcgaataaaatgtatgttcttcccccataacacttcaaccttgattcaaccaatgaatcaaggtgtgatcttgagctgcaaacggctgtatagatggaagcaacttgaagagagtcttgtaatatttgaagaaagtgatgatgagcaagagaaaggagataaaggagtttccaaaattaaaatctacaatataaaaagtgcaatttttaactgggcaaaaagttgggaagaagtaaaacaaataaccatagcaaatgcatgggaaaatcttctttacaaaaaggaacctgaatatgattttcaaggcttagaacatggggattatagagaaattcttgaaaaatgtggggagttggaaactaagttggatgatgatagggtgtggttaaatggagatgaagaaaagggttgtctcctaaaaaccaaaggtggaataacaaaggaagttgttcaaaaaggaggagaagctgagaagcagactgctgaatttaaattatctgctgtaagagagagtttggactaccttcttgactttgttgatgccacacctgagtttcagagattccacttcacactgtgtgagttctctgatgactcataa

SEQ ID NO: 31672 - DNA, 2720 bp, Homo sapiens
acccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacgtccagagtccttctggccacatctctgagcctgcctccttcttgcttctcagcaggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggt

SEQ ID NO: 31673 - DNA, 2778 bp, Homo sapiens
agatgacgcgacacgccaagtgcgtggggattcccgcggccctggccactacccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggtacctgctgtcactgactcctgaattcattctcgctgtgtgtctacttttgcttttttggagctgtggctaaaggaagtggaggggccgtgggatgcggagagccgagggctaactcccggacagcggaacagagagagctgccgacaaacagacggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtatg

SEQ ID NO: 31674 - DNA, 2751 bp, Homo sapiens
agatgacgcgacacgccaagtgcgtggggattcccgcggccctggccactacccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacgcaggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactggcctctcttagccacagctggatttttgcaatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtatg

SEQ ID NO: 31675 - DNA, 2695 bp, Homo sapiens
acccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactggcctctcttagccacagctggatttttgcaatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggt

SEQ ID NO: 31676 - DNA, 2665 bp, Homo sapiens
acccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggt

SEQ ID NO: 31677 - DNA, 2752 bp, Homo sapiens
acccggcctgccccgcggcaagatggcggcctgaacgcagctggcagcggcggaaagtttctgaagattcaggtgccccagggactggaagaaattacagtgcctacttggaaagaagaagagatagcgacttgccccagtccaaccccagagcggctccggagttgggctgctcacaaaccaagctgtctgtttatatggagtgcctggagggcatctgccatgagtctgtcgctaactgcactaaccaggagagctggctggttggggagaagacactaaccctgagctgtggctaaaggaagtggaggggccgtgggatgcggagagccgagggctaactcccggacagcggaacagagagagctgccgacaaacagacgcaggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggt

SEQ ID NO: 31678 - DNA, 2572 bp, Homo sapiens
agatgacgcgacacgccaagtgcgtggggattcccgcggccctggccactacccggcctgccccgcggcaagatggcggcctgaacgcagctggcagcggcggaaagagctgtggctaaaggaagtggaggggccgtgggatgcggagagccgagggctaactcccggacagcggaacagagagagctgccgacaaacagacggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtatg

SEQ ID NO: 31679 - DNA, 2716 bp, Homo sapiens
agctttcagagtcctggtgcagcctggcagcagtgtttggggaacaggcgagatagaggagctgagccccttctccaacagccgtcctctctttctgttgaccaaccagagaggctttttgcctgaggtcagcaagctggcctccctggttggcagggggagtgcttggcttccatctggcatggtttccggatgggagaaagcccctgagggtctggtggagctgtggctaaaggaagtggaggggccgtgggatgcggagagccgagggctaactcccggacagcggaacagagagagctgccgacaaacagacggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactggcctctcttagccacagctggatttttgcaatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtatg

SEQ ID NO: 31680 - DNA, 909 bp, Homo sapiens
acccggcctgccccgcggcaagatggcggcctgaacgcagctggcagcggcggaaagtttgcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacgcaggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactggcctctcttagccacagctggatttttgcaatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgat

SEQ ID NO: 31681 - DNA, 3268 bp, Homo sapiens
gctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatgtgagtagaactcaccccctccctgcccacatagaccattccggccactgtaggactcctctaactccagtttctgcacctctctctgtcctcctcttcccactttgccctcctcttgcctccatgtcacctctcaagccagtcaactctgccactggttggtgtcccgtgtactgtccagggcccatcactagttctggggggccagccctgttggtttctgtaacagagacagagagagaagatcctgggcaggaaggagagggtagtcagagctatctgcccaaagagtactaagagaggattaggcccatctgatcatgttaccccaaggggtaaactctagaccccacagcttcaggcccaaggtttatgtggcctgcagaagtagaagaagtagaggtatttctttttttttttttttttgagacggagtcttgctctgtcacctaggctggagtgcagtggcacaatctcggctcactgcaacctccgcctcccggcttcaagcaattctcctgcttcagcctcccaagtagctggaattataggcgcccaccaccacgcctggctaatttttttgtctttttagtagagatggggtttcatcgtgttagccaggatggtctcgatctcctgacctcgtgatccacccgcctcggcctcccaaagtgctgggattacaggcatgagccactgtgcccggcccagaagtagaggtatttctaaggctactggtctatgcagattctccaaacttaagtatggtttgggcagaagctgggagatagaagtttgagaacatgctggctgcagcagcagatccgggtttaaatcttggccaagttaaccaaagctttgagttgtcttcccctctccaggcctatgtgtctgtgaagtgagggtatacacactggcatgctgtaagaacaggagatagcagagtgctgagtacacagaggtacttaaaggtgggagccattactttcgccatgagtcaagttatctttggctgcgatcattgatgtctctctttcctgctcttttacctcagctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggt

SEQ ID NO: 31682 - DNA, 7950 bp, Homo sapiens
cgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgccgccagccatctctccgagcctgcaaagccagcgcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttctttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 31683 - DNA, 5007 bp, Homo sapiens
atgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgccgccagccatctctccgagcctgcaaagccagcgcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgatcctaaaacctggcaaaacaagtgtcttcccggagatccaaattatctcgttggagcaaactgtgtttctgtccttattgaccacttttaa

SEQ ID NO: 31684 - DNA, 3725 bp, Homo sapiens
tgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaccccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggaggtgaggcgaggcaggccacgggcaggaacaggagagcctggtgttttccttgcactctcgtggacagctgtgtgttcagggtgctgtggaaggcattcctaagggttggagcagatgacttccagggagtctctcgctttgagtccacgctggcatggttgcagtctgtgggaaagtggggcaggcaggtggacttcagaagagcttgaggggtcagcactccgcacacccatgccctcaggtgcgatggataaacagaatggctttaggtgccgtctgtccaaattaccagcggaaccttccttcccatgcagtattgttgtatgtacttgtaacctttgattaggtttctctctgtactcttagatgtccttgcttttcttccccatcctgcctttaacctttctaatcttgccaaagctcttgagtgtttccccatcagtttccttctctcttatatttcagttttttaattgagttcatgatcaaaccttcatctgatcacatcacatgtactgtgcatccactgtgattagatagcttatgggatccttgaaatcacattgacaggcactgtaaagtcacagccaagttagcaattattagttgcacctcagagaatgttggaataatgatctttgaagatgggattgttcatatatttggataattattgctgtggatttctctctagcattttagctcattccagtaaatgatttttttctttatgaaatagaactaccaaaaaaaaaaaaaaaaaaaa

SEQ ID NO: 31685 - DNA, 4058 bp, Homo sapiens
agagcactgtccggtggtgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaccccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctgtttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaa

SEQ ID NO: 31686 - DNA, 4611 bp, Homo sapiens
gcggaggcgccacgctcgggtcgggggcgggctgacgccgccgccgccgcgggaggagggacaaaggggtgggtccccgcgggtcggcaccccggcggttgggctgcgggtcagagcactgtccggtggtgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaccccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagagcataaggaaacccagcccagagccacgagctcagatgaggagggctgctagcagcgatcaacttagggacaatagcccgcccccagcattcaagccagagccgcccaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctgtttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaa

SEQ ID NO: 31687 - DNA, 588 bp, Homo sapiens
tccagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtaagtactgggtttgctttcagcttgccttaatagcattttggttttttgcccagaagaaaattaccccttgcttttaagcatttgacagaattacataacctagggaccgctgttcttggatcctcagtacttttggaggggtgtgaagatatgtgtaagttatcttcctacttttcc

SEQ ID NO: 31688 - DNA, 614 bp, Homo sapiens
gggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcc

SEQ ID NO: 31689 - DNA, 4085 bp, Homo sapiens
agctgcgtctccctcccggggctcgcgcgcccagaaccctccggtctcaaggaagcagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaccccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctgtttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaatttt

SEQ ID NO: 31690 - DNA, 4459 bp, Homo sapiens
atatggatgtgtcactgtgtgagatgacaacaggatttgctggaaatgtgggccactattgtatccgccttacgtaaccacatggagtgatggaaatgggtgagcagcccggaatgtaggcggtggcctggcccatgcatctccagagaccatgaagactgctcaagccctacataggatgtggatccaggctgttaaaaagttgaggagatggaaaggccgtgccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaccccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctgtttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaatttt

SEQ ID NO: 31691 - DNA, 4500 bp, Homo sapiens
atgaagactgctcaagccctacataggatgtggatccaggctgttaaaaagttgaggagatggaaaggccgtgtgagtccctctgcaagctctccccttgttttccccaacctttcttcatgggaaggggagggaagcaaaaccattctcacagccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaccccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagagcataaggaaacccagcccagagccacgagctcagatgaggagggctgctagcagcgatcaacttagggacaatagcccgcccccagcattcaagccagagccgcccaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctgtttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaatttt

SEQ ID NO: 31692 - DNA, 3068 bp, Homo sapiens
agccgggagctgcggagctggagggaggaggacgagagcccggccctcagcccgctgtgactctcctcagccccctcccccagcccggggtgggggccgattgactgtttccaggaccccctcgggtaggggggctggagagcccccaggtggaccatggcggtgagattccaggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagaggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttatgcgagtacatgatgcggagtcctccgatgaagacggctatgactggggtccggccactgacctgtgacctctcgaaggctgccagctggtccgtcctccttctccctccctggggctgggactcagtttcccatacagaacccacaaccttacctccctccgcctggtctttaataaacagagtattttcac

SEQ ID NO: 31693 - DNA, 2859 bp, Homo sapiens
atgaacctgtgtggcctcatgcccatcttccccgctcccctcgaccaggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggaaggcgtgaccatggctgatgagatgtcctctccccctgcagacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagaggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttatgcgagtacatgatgcggagtcctccgatgaagacggctatgactggggtccggccactgacctgtga

SEQ ID NO: 31694 - DNA, 3110 bp, Homo sapiens
agccgggagctgcggagctggagggaggaggacgagagcccggccctcagcccgctgtgactctcctcagccccctcccccagcccggggtgggggccgattgactgtttccaggaccccctcgggtaggggggctggagagcccccaggtggaccatggcggtgagattccaggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggaaggcgtgaccatggctgatgagatgtcctctccccctgcagacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagaggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttatgcgagtacatgatgcggagtcctccgatgaagacggctatgactggggtccggccactgacctgtgacctctcgaaggctgccagctggtccgtcctccttctccctccctggggctgggactcagtttcccatacagaacccacaaccttacctccctccgcctggtctttaataaacagagtattttcac

SEQ ID NO: 31695 - DNA, 2894 bp, Homo sapiens
caggcacccgggccctggcacctgctgcctgcccagaggccacccagcctcctagacaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagaggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttatgcgagtacatgatgcggagtcctccgatgaagacggctatgactggggtccggccactgacctgtgacctctcgaaggctgccagctggtccgtcctccttctccctccctggggctgggactcagtttcccatacagaacccacaaccttacctccctccgcctggtctttaataaacagagtattttc

SEQ ID NO: 31696 - DNA, 3075 bp, Homo sapiens
agttccactggcaggggacctgcctccctgttgccaccacaagagaggaaaagttggtcaaacaggtggggaggccagagctacaagcctcgggttccctccccaccacccgtgccaggcaggcacccgggccctggcacctgctgcctgcccagaggccacccagcctcctagacaggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagaggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttatgcgagtacatgatgcggagtcctccgatgaagacggctatgactggggtccggccactgacctgtgacctctcgaaggctgccagctggtccgtcctccttctccctccctggggctgggactcagtttcccatacagaacccacaaccttacctccctccgcctggtctttaataaacagagtattttcacagc

SEQ ID NO: 31697 - DNA, 4376 bp, Homo sapiens
gaccggtccagctgagcctggtggcggaaaggctgcggccccgcgccagagggccggtggctcctccgggcttctgaggacccgcagggagcgggcctcatcatttctgtctcctgtttctccacttccttctctgttggttggtccactgatgtatggacttgcacatgatgaactgtgaacttctagccacatgtagtgcccttgggtacttggagggagacacttaccataaggaaccagattgcttagagagcgtgaaggatctgatccgctatttgaggcatgaggatgagacacgagatgtgcggcagcagctgggggcagcccagatcctacagagcgaccttctgcccatcctcacccagcaccaccaggacaagcctctctttgatgctgttatcagactgatggtgaacttgacacaaccagccttgctctgttttggcaatctgcctaaggagcccagctttcggcaccattttttgcaggtgctaacttatttgcaggcctacaaagaggcctttgccagtgagaaggcttttggagtcctcagtgaaaccttgtatgagctgctgcagctgggctgggaggaacggcaggaggaagacaacttgctgattgaacggatcctactgctggtcagaaatattctccatgtcccagctgaccttgatcaggagaagattgatgatgacgccagtgcccatgaccagctcctctgggcgattcacctcagcggcctggatgacctgctcctctttctggccagctcgtctgctgaggagcaatggagcctacatgtgctagagattgtctcccttatgtttcgtgaccagaaccccgagcagctggcgggagtagggcagggacgcttagctcaggagcggagtgcagattttgcagaactggaggtgttgcgccagcgagagatggcagaaaagaagactcgagccctccagcgaggcaacaggcattctcgatttgggggctcctatattgtccaggggttgaaatccattggggagagggacctcatctttcacaaaggccttcacaacctacgaaactacagttcagatttgggaaagcagccgaaaaaggtgcctaaacgtcgccaggccgcccgagagctgtccattcagcgccgttctgccctcaatgtgaggctcttcctcagagacttctgctctgagttcctggagaactgttacaaccggctcatgggatcagtaaaggatcacctgcttcgggagaaagctcagcagcatgatgagacctattatatgtgggccttggctttcttcatggccttcaaccgagctgcctccttccggccaggcctggtttctgagaccctcagtgtccgtaccttccacttcattgagcagaacctcaccaactactatgagatgatgctgactgaccgcaaggaagctgcctcctgggcacgccggatgcacttggctctgaaggcctatcaggagctgctggcaacagtgaatgagatggacatatctccagatgaggctgtgagggagagcagccgcatcatcaagaacaatattttctatgtgatggagtaccgagaactattcctggcactttttcgaaagtttgatgagagatgccagccccgctctttccttcgtgacctggtggagaccacccacctcttcctcaaaatgttggagcgattctgtcggagccgtgggaacctggtggtgcagaacaaacaaaagaagagaaggaagaagaagaagaaggtcctagaccaggccattgtttctggtaatgtcccatctagcccagaagaagtggaggctgtgtggccagccctggctgagcagctacagtgctgtgcccagaattctgagctcagcatggactccgtggttccctttgatgcggcctcagaggtgccagtggaggagcagcgggcagaagctatggtacggatccaagactgtctcctggctggccaggccccacaggccctgactctcctgaggtctgctcgggaggtgtggcctgaaggagatgtgtttggctctcaagacatttctccagaggaagagatccagttgctgaaacaaatcctctctgctccacttccccggcagcagggcccagaggaacgtggggcagaggaagaagaagaggaggaggaggaggaagaggaggagttgcaagtggtccaggtgtcggagaaagaatttaattttctggactacctgaaacgctttgcatgttcaactgtcgttcgagcctatgtgctgctactaaggagctaccagcagaatagtgcccacactaaccattgcattgtgaagatgctgcaccggctggcccatgacctcaaaatggaagccctactttttcagctgtcagtcttctgcctcttcaatcgtctgcttagtgaccctgctgctggagcctacaaagagctagtgacttttgccaaatacatcctgggcaaattttttgcactggctgcagtcaaccaaaaagcctttgtggagctgttgttctggaagaacacagctgtggttcgagagatgactgagggctatggctccctggatgacaggtcttccagtcgcagagcacctacatggagccccgaagaagaggctcatcttcgggagctgtacctcgccaataaggacgtggaagggcaggatgtggtggaagccatcttggcccacctgaatactgttcctcgaacacgcaagcagatcatccaccatctggtacagatgggactggctgacagtgtcaaggacttccaaaggaaaggaacccatattgtactgtggacgggggatcaggagttggagctgcagcggctttttgaggaattccgggactcagatgatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttgccaaatggagcggagtccctgaaagatttttgccaggaagatctggaagaagaggaaaacctgcctgaggaagacagcgaagaggaagaagaagggggctcagaagcagaacaagtccagggtagcttagtcctttcaaatgaaaaccttggtcaaagcctgcatcaggaaggcttttctatcccgctcctatggctccagaactgcctgatccgagcagctgatgatcgggaagaggatggctgctcccaggccgttccattggtgccactcacagaggaaaatgaggaagccatggaaaacgaacagtttcagcagctgttgcgcaagctaggggttcggccccctgcctctgggcaggaaaccttctggcgaattccagccaagctgagtcctacccagctccggagggcagcagcttctttgagtcaaccagaggaggaacagaagctgcagccagagctgcagcctaaagtccctggagagcaaggctctgatgaggagcactgtaaagagcaccgagcacaagccctgagggccctcttgctagcccacaagaagaaagcgggcctggcatccccagaggaggaagacgctgttggtaaagagccgctgaaggcagcacccaagaaacgacaattgctggacagcgacgaggaacaggaagaagatgagggcaggaacagagcaccagagttgggagctccaggaatccaaaagaagaaacgataccagattgaggatgatgaggatgactgaagagctaagaagcctaggggtagagatagacacgtttttagatggtgcattcaagtcagagttggaagggtcatacaggacccagaagctcctcttactggacagagcagtagaatcccaggctctttcacggatttaggctgagaaacttcagcagcagtattggacttctctgctgtcagtctttgtttctcccagtttttatcggtatgccccagcagctctctggagatttagttctcttcttctaggaaccatttcttttggttattggagctccttagcaaataagaggagtgagtgaaatagagaaagcaccccggaccccttttattggtctgttcctttggctttctcttggaggtgggtcgcagcaccagatggggagctttatgacatgacaggcgggagttttgtaccacttttagaagataccagatgcctctgtcctcattttgtttcctatgatcatcctctagataccagatagaggcccattcctgcatttgagatagggttggaatatagtactctagatgatgaatgtgtttgctttgtgtttggtattaaacatgtaagattagaagttctcatctc

SEQ ID NO: 31698 - DNA, 4371 bp, Homo sapiens
ggtccagctgagcctggtggcggaaaggctgcggccccgcgccagagggccggtggctcctccgggcttctgaggacccgcagggagcgggcctcatcatttctgtctcctgtttctccacttccttctctgttggttggtccactgatgtatggacttgcacatgatgaactgtgaacttctagccacatgtagtgcccttgggtacttggagggagacacttaccataaggaaccagattgcttagagagcgtgaaggatctgatccgctatttgaggcatgaggatgagacacgagatgtgcggcagcagctgggggcagcccagatcctacagagcgaccttctgcccatcctcacccagcaccaccaggacaagcctctctttgatgctgttatcagactgatggtgaacttgacacaaccagccttgctctgttttggcaatctgcctaaggagcccagctttcggcaccattttttgcaggtgctaacttatttgcaggcctacaaagaggcctttgccagtgagaaggcttttggagtcctcagtgaaaccttgtatgagctgctgcagctgggctgggaggaacggcaggaggaagacaacttgctgattgaacggatcctactgctggtcagaaatattctccatgtcccagctgaccttgatcaggagaagaagattgatgatgacgccagtgcccatgaccagctcctctgggcgattcacctcagcggcctggatgacctgctcctctttctggccagctcgtctgctgaggagcaatggagcctacatgtgctagagattgtctcccttatgtttcgtgaccagaaccccgagcagctggcgggagtagggcagggacgcttagctcaggagcggagtgcagattttgcagaactggaggtgttgcgccagcgagagatggcagaaaagaagactcgagccctccagcgaggcaacaggcattctcgatttgggggctcctatattgtccaggggttgaaatccattggggagagggacctcatctttcacaaaggccttcacaacctacgaaactacagttcagatttgggaaagcagccgaaaaaggtgcctaaacgtcgccaggccgcccgagagctgtccattcagcgccgttctgccctcaatgtgaggctcttcctcagagacttctgctctgagttcctggagaactgttacaaccggctcatgggatcagtaaaggatcacctgcttcgggagaaagctcagcagcatgatgagacctattatatgtgggccttggctttcttcatggccttcaaccgagctgcctccttccggccaggcctggtttctgagaccctcagtgtccgtaccttccacttcattgagcagaacctcaccaactactatgagatgatgctgactgaccgcaaggaagctgcctcctgggcacgccggatgcacttggctctgaaggcctatcaggagctgctggcaacagtgaatgagatggacatatctccagatgaggctgtgagggagagcagccgcatcatcaagaacaatattttctatgtgatggagtaccgagaactattcctggcactttttcgaaagtttgatgagagatgccagccccgctctttccttcgtgacctggtggagaccacccacctcttcctcaaaatgttggagcgattctgtcggagccgtgggaacctggtggtgcagaacaaacaaaagaagagaaggaagaagaagaagaaggtcctagaccaggccattgtttctggtaatgtcccatctagcccagaagaagtggaggctgtgtggccagccctggctgagcagctacagtgctgtgcccagaattctgagctcagcatggactccgtggttccctttgatgcggcctcagaggtgccagtggaggagcagcgggcagaagctatggtacggatccaagactgtctcctggctggccaggccccacaggccctgactctcctgaggtctgctcgggaggtgtggcctgaaggagatgtgtttggctctcaagacatttctccagaggaagagatccagttgctgaaacaaatcctctctgctccacttccccggcagcagggcccagaggaacgtggggcagaggaagaagaagaggaggaggaggaggaagaggaggagttgcaagtggtccaggtgtcggagaaagaatttaattttctggactacctgaaacgctttgcatgttcaactgtcgttcgagcctatgtgctgctactaaggagctaccagcagaatagtgcccacactaaccattgcattgtgaagatgctgcaccggctggcccatgacctcaaaatggaagccctactttttcagctgtcagtcttctgcctcttcaatcgtctgcttagtgaccctgctgctggagcctacaaagagctagtgacttttgccaaatacatcctgggcaaattttttgcactggctgcagtcaaccaaaaagcctttgtggagctgttgttctggaagaacacagctgtggttcgagagatgactgagggctatggctccctggatgacaggtcttccagtcgcagagcacctacatggagccccgaagaagaggctcatcttcgggagctgtacctcgccaataaggacgtggaagggcaggatgtggtggaagccatcttggcccacctgaatactgttcctcgaacacgcaagcagatcatccaccatctggtacagatgggactggctgacagtgtcaaggacttccaaaggaaaggaacccatattgtactgtggacgggggatcaggagttggagctgcagcggctttttgaggaattccgggactcagatgatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttgccaaatggagcggagtccctgaaagatttttgccaggaagatctggaagaagaggaaaacctgcctgaggaagacagcgaagaggaagaagaagggggctcagaagcagaacaagtccagggtagcttagtcctttcaaatgaaaaccttggtcaaagcctgcatcaggaaggcttttctatcccgctcctatggctccagaactgcctgatccgagcagctgatgatcgggaagaggatggctgctcccaggccgttccattggtgccactcacagaggaaaatgaggaagccatggaaaacgaacagtttcagcagctgttgcgcaagctaggggttcggccccctgcctctgggcaggaaaccttctggcgaattccagccaagctgagtcctacccagctccggagggcagcagcttctttgagtcaaccagaggaggaacagaagctgcagccagagctgcagcctaaagtccctggagagcaaggctctgatgaggagcactgtaaagagcaccgagcacaagccctgagggccctcttgctagcccacaagaagaaagcgggcctggcatccccagaggaggaagacgctgttggtaaagagccgctgaaggcagcacccaagaaacgacaattgctggacagcgacgaggaacaggaagaagatgagggcaggaacagagcaccagagttgggagctccaggaatccaaaagaagaaacgataccagattgaggatgatgaggatgactgaagagctaagaagcctaggggtagagatagacacgtttttagatggtgcattcaagtcagagttggaagggtcatacaggacccagaagctcctcttactggacagagcagtagaatcccaggctctttcacggatttaggctgagaaacttcagcagcagtattggacttctctgctgtcagtctttgtttctcccagtttttatcggtatgccccagcagctctctggagatttagttctcttcttctaggaaccatttcttttggttattggagctccttagcaaataagaggagtgagtgaaatagagaaagcaccccggaccccttttattggtctgttcctttggctttctcttggaggtgggtcgcagcaccagatggggagctttatgacatgacaggcgggagttttgtaccacttttagaagataccagatgcctctgtcctcattttgtttcctatgatcatcctctagataccagatagaggcccattcctgcatttgagatagggttggaatatagtactctagatgatgaatgtgtttgctttgtgtttggtattaaacatgtaagattagaagttctca

SEQ ID NO: 31699 - DNA, 1236 bp, Homo sapiens
ggagttcccgagtatcgcgagaagcgcgcttagtctgcacgccgaggtccgcgctgtgtcccgtgttttctgcgtgagaggaaaagatgctagaaccacaggagaatggcgtgattgacctaccagattatgagcatgtagaagatgaaacttttcctcctttcccacctccagcctctccagagagacaagatggtgaaggaactgagcctgatgaagagtcaggaaatggagcacctgttcgtgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgagagaaataaacaactggccttggaaagaaggcaggcaaagctgctgagtaatagtcagaccctaggaaatgatatgttaatgaatacacccagggcacacacggttgaagaggttaatactgatgaggatcaaaaggaggagtcaaatggattaaacgaagacattctggacaatccatgtaatgatgctattgccaatactttaaatgaagaggaaacactgctggaccagtcttttaaaaatgtgcaacagcaacttgatgctacatccagaaatattactgaagctagataagtttccattaagagaaaatgtatctgttaagtcatcgtcctgcaagcttggcgttactatgtattttttcttcttggagtgaaaatccttagatagtaaaactgttatagattattgtttaaaatctgataatctggtatttatttataattatgcttgtcactttagttaaatctatttgttctctttagtgtttgtttttatataggtatttcttcataaaatgattaggaggtaataagca

SEQ ID NO: 31700 - DNA, 1459 bp, Homo sapiens
agtctgcacgccgaggtccgcgctgtgtcccgtgttttctgcgtgagaggaaaagatgctagaaccacaggagaatggcgtgattgacctaccagattatgagcatgtagaagatgaaacttttcctcctttcccacctccagcctctccagagagacaagatggtgaaggaactgagcctgatgaagagtcaggaaatggagcacctgttcgtgtacctccaaagagaacagttaaaagaaatatacccaagctggatgctcagaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgagagaaataaacaactggccttggaaagaaggcaggcaaagctgctgagtaatagtcagaccctaggaaatgatatgttaatgaatacacccagggcacacacggttgaagaggttaatactgatgaggatcaaaaggaggagtcaaatggattaaacgaagacattctggacaatccatgtaatgatgctattgccaatactttaaatgaagaggaaacactgctggaccagtcttttaaaaatgtgcaacagcaacttgatgctacatccagaaatattactgaagctagataagtttccattaagagaaaatgtatctgttaagtcatcgtcctgcaagcttggcgttactatgtattttttcttcttggagtgaaaatccttagatagtaaaactgttatagattattgtttaaaatctgataatctggtatttatttataattatgcttgtcactttagttaaatctatttgttctctttagtgtttgtttttatataggtatttcttcataaaatgattaggaggtaataagcagtttctgctgctggtctgtcattgaatgccttgttttcactaagttgggaggttttgtttctgttttttactgctccttgcaaagcagggctaatccatggacagtgtgcccagagtagtctagttgaagttttttgttttgttttgttttgttttttttgacacagagtctcactctgttggccaggctggagtgcagtggcacagtcttggctcactgcaacctctgcctcctgggctcaagcaattctcctgccttagcctcccgagtagctgggactacaggcgtgtgccaccacgcttggctaatttttgtacttttagtagaga

SEQ ID NO: 31701 - DNA, 727 bp, Homo sapiens
cctctgcgggtcctgcctcagccatgatgatccacggcttccagagcagccaccgggatttctgcttcgggccctggaagctgacggcgtccaagacccacatcatgaagtcggcggatgtggagaaattagccgatgaattacatatgccatctctccctgaaatgatgtttggagacaacgttttaagaatccagcatgggtctggctttggaattgagttcaatgctacagatgcgttaagatgtgtaaacaactaccaaggaatgcttaaagtggcctgtgctgaagagtggcaagaaagcaggacggagggtgaacactccaaagaggttattaaaccatatgattggacctatacaacagattataagggaaccttacttggagaatctcttaagttaaaggttgtacctacaacagatcatatagatacagaaaaattgaaagccagagaacagattaagttttttgaagaagttctcctttttgaggatgaacttcatgatcatggagtttcaagcctgagtgtgaagattcctggtggcgggcacctgtagtcccagctactcgggaggctgaggcaggagaagcgtgaacccgggaggcggagcttgcagtgagctgagatcgcaccactgcactccagccctccagcctgggcgacagagcaagactccgtctcaaaaaaaaaaaataaaataaaataaaagaagtagaaaacaca

SEQ ID NO: 31702 - DNA, 1630 bp, Homo sapiens
gggtcggccggcagggggcggggccgggcatggtaacggctcggaagcctaggaggctgggccggagggaggcggaggaaccggtgttcgccgccgccgctgcttcagcttattccttgtggcctctgcgggtcctgcctcagccatgatgatccacggcttccagagcagccaccgggatttctgcttcgggccctggaagctgacggcgtccaagacccacatcatgaagtcggcggatgtggagaaattagccgatgaattacatatgccatctctccctgaaatgatgtttggagacaacgttttaagaatccagcatgggtctggctttggaattgagttcaatgctacagatgcgttaagatgtgtaaacaactaccaaggaatgcttaaagtggcctgtgctgaagagtggcaagaaagcaggacggagggtgaacactccaaagaggttattaaaccatatgattggacctatacaacagattataagggaaccttacttggagaatctcttaagttaaaggttgtacctacaacagatcatatagatacagaaaaattgaaagccagagaacagattaagttttttgaagaagttctcctttttgaggatgaacttcatgatcatggagtttcaagcctgagtgtgaagattagagtaatgccttctagctttttcctgctgttgcggtttttcttgagaattgatggggtgcttatcagaatgaatgacacgagactttaccatgaggctgacaagacctacatgttacgagaatatacgtcacgagaaagcaaaatttctagtttgatgcatgttccaccttccctcttcacggaacctaatgaaatatcccagtatttaccaataaaggaagcagtttgtgagaagctaatatttccagaaagaattgatcctaacccagcagactcacaaaaaagtacacaagtggaataaaatgtgatacaacatatactcactatggaatctgactggacaccttggctatttgtaaggggttatttttattatgagaattaattgccttgtttatgtacagattttctgtagccttaaaggaaaaaaaaataaagatcgttacaggcaggtttcactcaactgctgtttgtactgtctgtcttcacattcatattccagatttatattttctggagttaaatttggatgatttctaaattatcacaaagtgggacctcagcagtagtgatgtgtgtgtctcatgagcagtgagcacagtctgcattcatcatgaaacactatcttctaccaggaggaggttaatgtaaatcaccaaatcccaatgccttgtgactttcataggattcctgatcatgcatgttgatgtactggctcttcactttgggctttctgatgtttattcacacctttggagagttgcaacttgccacatacgaaattagtctcatagtgtagtgaacttcaaccccaaaattttaaaaatgtatttccccccagttttaaattgcctttgaaatttaaaaaaaaaaaatttagacttagtaccagaaccaaaaatacctagatttttggagaacttattacatacatagaaacatgaatatggtttaccactgtgtgtgt

SEQ ID NO: 31703 - DNA, 3913 bp, Homo sapiens
attcccaactgccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgcttttttttttttttttcgaaaaagttcacccaatccctaggctttttacttttttctttttcttttcttttttcttgtttttttttttttttcattttgttttgttttgttatgtttttttagacagggtcccactctgtcacccaggctggagtgcagtggtgcaatcacaggacactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacagctgatgccagctacagaatcactatgtttcaatatggaatatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatg

SEQ ID NO: 31704 - DNA, 1088 bp, Homo sapiens
aacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgttacaaaagaaggaacaaatgatggttggaagaatgcggctcatatttaccaagtctttctgaacgccttctgcattcatgcatccatgttctttctaggattggatagcatttcatgcctatgttaatatttgtgcttttggcatttccttaatatttatatgtatacgtgatgcctttgatagcatactgctaataaagttttaatatttacatgca

SEQ ID NO: 31705 - DNA, 3649 bp, Homo sapiens
gcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgcttttttttttttttttcgaaaaagttcacccaatccctaggctttttacttttttctttttcttttcttttttcttgtttttttttttttttcattttgttttgttttgttatgtttttttagacagggtcccactctgtcacccaggctggagtgcagtggtgcaatcacaggacactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacagctgatgccagctacagaatcactatgtttcaatatggaatatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatgaaa

SEQ ID NO: 31706 - DNA, 1119 bp, Homo sapiens
agcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgttacaaaagaaggaacaaatgatggttggaagaatgcggctcatatttaccaagtctttctgaacgccttctgcattcatgcatccatgttctttctaggattggatagcatttcatgcctatgttaatatttgtgcttttggcatttccttaatatttatatgtatacgtgatgcctttgatagcatactgctaataaagttttaatatttacatgcatagtaaa

SEQ ID NO: 31707 - DNA, 554 bp, Homo sapiens
attcccaactgccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcact

SEQ ID NO: 31708 - DNA, 685 bp, Homo sapiens
ctctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttatgaagtcttgctctgttgcccaggctggagcgcagtggcacaatctcagctcactgaaaccttcgccccctgggctcaagctagccagtcttttagtaaacatttagtcaacaaatctgcaattataacggagtacgggtggctggcaagatggccgaataggaagagctccagtctacagctcccgcagagatcaacgcagaaggaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcc

SEQ ID NO: 31709 - DNA, 804 bp, Homo sapiens
aataaacagtcatgtcgctaacacaaagcctgtttggtggtctcttcacatggacgcgcgtgaaatttggtgccgtgactcggatcgggggacctcccttgggagatcaatcccctgtcctcttgttctttgctccgtgagaaagatccacctacgacctcaggtcctcagaccaaccagcccaagaaacatctcaccaatttcaaatccgttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgacaggaaaggccatgtgaggacatagggagaaagcagccaccattggcaagccaagagagagccctcaccaggaacgattggaccagcaccttgatcttggattttctagcctccagaactagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagag

SEQ ID NO: 31710 - DNA, 1161 bp, Homo sapiens
attcccaactgccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaa

SEQ ID NO: 31711 - DNA, 545 bp, Homo sapiens
agttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttactttacgggtggctggcaagatggccgaataggaagagctccagtctacagctcccgcagagatcaacgcagaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagag

SEQ ID NO: 31712 - DNA, 733 bp, Homo sapiens
attcccaactgccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgacaggaaaggccatgtgaggacatagggagaaagcagccaccattggcaagccaagagagagccctcaccaggaacgattggaccagcaccttgatcttggattttctagcctccagaactagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaa

SEQ ID NO: 31713 - DNA, 1362 bp, Homo sapiens
tcccggccccgccccccacctggctccgcgggcagccggagcgcacccggccggaagccgctgtcggggagccggcggtggggctggacgcaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggcctttgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtcccgggcaggcccggcgctttgctccccacaccagccccctgcgcgtgtccactctgatcctgcatcccactccctgggagccaataaagtgcattttcacaggc

SEQ ID NO: 31714 - DNA, 488 bp, Homo sapiens
gttgtttgctgcttgctgcccgagcctgggcgtacccatgggcgcgggtgacagtgcaagtgcttgggacgacaacccgggctcctcatcgcggccggaatccaagaggctgcggcgcgaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggcctttgaggtgggcgcccgcaaggtggtgtcctgcctgtccacctgtatcttccc

SEQ ID NO: 31715 - DNA, 869 bp, Homo sapiens
ggtgaggtggcaccggactcagccgcgccctgggccctggatgctccgtgagagtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggcctttgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaag

SEQ ID NO: 31716 - DNA, 1324 bp, Homo sapiens
tggacgcaggtgaggtggcaccggactcagccgcgccctgggccctggatgctccgtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggcctttgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtcccgggcaggcccggcgctttgctccccacaccagccccctgcgcgtgtccactctgatcctgcatcccactccctgggagccaataaagtgcattttcacaggc

SEQ ID NO: 31717 - DNA, 871 bp, Homo sapiens
ggccccctcccctaagggctggccctggggccctgccgggggagcccgagcaggtttccggctcccaggatgggatccttgagggtggctgcgccccgaggcctgtcctgccctggaggaatctggctcgccagggctctccaggaccagccagcctcgagtgggcgtgggctgcacacaggcgccgtctcgtgcctgtccctagcatgcgggctttagctgcgaaccgtgttaacgacctgtgccaggagcccccgtcccaaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggcctttgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaa

SEQ ID NO: 31718 - DNA, 2944 bp, Homo sapiens
caagagctttcaaatagaactatggtggagaaaagtagtattgatgaaaattccatttctttagaaaaagaagtccgacatgtacaggaacaaaacttagacattttaaaaactgatctttctcttaaatccttttctgaagaaatctatagtgaatcatgtgccctacttccaacctcatctgcagatatagaagaaactgatctttctgagaaaagttgtcctctagaaaatggaggcagaagttccatctcacatttgaaaaaagcagcaagtgaggaaaagcctttaggggttggtgaaatggaagaagaatgcactctagaaccagagttggcagcatttccaaagcaggatggtgggacacaggaatatacagatgccactttggaagaccacagaggtgatgttcaggaagctgacacactccatagacagctctccctgagtcagtgcttcccactcttgatgactgaagaacaacagaatccaggtgaacaaataagtacaaacattcatgcctctggagaagaaaaatgttatgaagaagttcaagttcagaatgaagcttctttctccactttagaaggagaaatgatagaaactagtttttctcaaaatattcctaaattagatgaggcacataccactgaggcagcagaatctgagacctccctaacacaatatttacttgctgctggaaagcgtgaggttcctgaaactaaagacaccagagaccaggcaaagcttgtccagagtgaatcaatcacttcaatggaggtggaagaagtaactttcaacactgtgtatgaatactacaaccagaaacaggaatcactaggtcgtccactttctcctgagtctgacatttccattggtgtgggaagtacaaccagtgaagaaatatctgagttagatcagttttataccccaccatcatctgttgaatattttgaatctccaaagtcccctgacttatattttaatccttcagatataactaaacaatcctcaatacattcaggaggtgagacagttgaaagatattccacacctttaggggaagttgctgaaagatattcaacaccttccgaaggtgaggtaggagaaagatactccacacccccaggggagacactagagagatactccacacctccaggagagactctagagagatactccacacccccaggggaggcactagagagatattctattcctactggaggaccaaaccccactggtacttttaaaacatatccatcaaaaatagaaagggaagacggtacaccaaatgagcatttctacacacctacagaagagaggggttcagcttatgaaatatggcgttccgattcatttggtacacccaatgaagccattgagccaaaagacaatgaaatgcctccatcttttattgaacctctgaccaaaaggaaggtatatgaaaacacaacactaggcttcattgttgaagttgaaggtcttccagttcctggtgtgaaatggtatcgaaataaatctttactagagccagatgaaagaatcaaaatggaaagagtgggtaatgtgtgttcactggaaatttctaacattcaaaaaggagaagggggagagtacatgtgtcatgctgtaaacatcataggggaagcaaagagctttgcaaatgtagacataatgccccaggaagaaagagtggtggcactaccacctccagtaacacatcagcatgtcatggagtttgatttggaacacaccacatcatcaagaacaccttctcctcaagaaattgtcctggaagttgaattaagtgaaaaagacgttaaagaatttgagaagcaggtgaaaatagtgacagttcccgaatttactcctgaccataaaagtatgattgtgagtctagatgttcttccatttaattttgtagatccaaatatggattcaagggagggagaagacaaagaactaaaaattgatttagaagtatttgaaatgcctcctcgctttataatgcctatttgtgattttaaaattccagaaaattcagatgctgtattcaaatgttcagtcatagggatcccgactcccgaagttaagtggtataaagaatatatgtgtattgagccagataatattaaatacgtgattagcgaggagaagggaagtcacactcttaaaattcgaaatgtctgtctttctgatagtgcaacatacaggtgcagagctgtgaattgtgtaggagaggctatctgtcggggattcctcaccatgggagattctgaaatatttgctgtgatagcaaagaaaagcaaagtgactttaagcagtttaatggaagaattggtcttaaagagcaactacacagacagtttttttgaatttcaggtggtggaagggcctcccaggtttatcaaaggtatttctgactgttatgcaccaataggtacagcagcatattttcagtgcttagttcgtggctctccaagacccacggtttactggtacaaagatggaaaattagtccaaggaagaaggttcactgttgaggaaagtggcacagggttccataacctgtttataacaagcttagtaaagagtgatgaaggagagtataggtgtgtagctacaaacaaatcaggaatggctgagagctttgcagcactcaccttaacttaaaatgtaatgttttagtgcctcagtaattattagcattgatctgagtgctttcatattttccaaattatgtggatctaataaacttccaaacaggtccaccatatttgaattcattaccttggagacccctaaagaaataatctctatgtagaaatctcatctttgtaatacatgtaaatattttgttatctgaactgtggaatcatcacttgtgtcaatcatgctgtgtaatatcaaacacaattaaatctctccttggctacct

SEQ ID NO: 31719 - DNA, 17305 bp, Homo sapiens
gagcagtcgtgcattcccagcctcgcctcgggtgtagggattgcatagaaaagcaaaactacacagtcttgactgtgtagttttgtttttaggattagaggctcaccgattcatgtcggagatggtcagaaaaaccaactctccataggacgtcgtttcagaagcaaccttgggcttagtcccaccctttttaggcactcttgagaaatcagagtgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttccactctgcccggcgtgcagatctcctttagcgatggccgcgctaaactgacgatccccgccgtgactaaagccaacagtggacgatattccctgaaagccaccaatggatctggacaagcgactagtactgctgagcttctcgtgaaagctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctgggcaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtgctgccgccagtgtgtcggccagtgctagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaataagacaggaaactgagataactgctgcatccatggtggtagttgccactgcaaagtccacaaaactagaaacagtcccgggagctcaagaagaaactaccacacaacaagatcaaatgcacctaagttatgaaaagataatgaaggaaactaggaaaacagttgtacctaaagtcatagttgccacacccaaagtcaaagaacaagatttagtatcaagaggtagagaaggcattactaccaaaagagaacaagtgcaaataactcaggagaagatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtgaagctggcgttgaggtgaaaaaggaagtaggggtgagcatcactggcaccaccgtccgtgaagagcgctttgaagtactgcacggacgcgaagccaaggtaacagaaacagcaagagtaccagcacctgttgaaattcctgttactccaccaactttggtctcgggcttaaaaaatgtgactgtcatagaaggtgaatctgtcaccttggagtgccacatctctggatacccatccccgacagtgacatggtacagggaagactaccaaatcgaaagttccattgacttccagataaccttccagagtggaattgctcgtcttatgattcgcgaagcatttgcggaagacagcgggcgatttacttgcagtgctgtaaatgaggctggaaccgtcagcacatcctgctatctggctgtgcaggtgtcagaagaatttgaaaaggaaaccacagccgtgactgagaaatttactacagaagagaaacgctttgttgagtcaagagatgtggttatgactgatactagcctcacagaggaacaagcagggcctggagaacctgccgcgccttactttattacaaaaccagtggtccagaaactggtggaaggtgggagcgtggtgtttggatgccaagttggcggcaacccaaagccccatgtatactggaaaaaatctggtgttcctctaaccactggatacagatacaaagtgagttacaacaaacaaaccggtgaatgcaagctggtgatttctatgacttttgctgatgatgctggagaatacactattgttgttcgcaataagcatggagaaacttctgcatctgcttccttgcttgaagaagctgattatgagttactgatgaagtcccagcaagaaatgctttatcagacacaagtgactgcatttgttcaagaacctaaagttggagaaacagcacctggatttgtatactctgagtatgaaaaagagtatgaaaaagaacaagccttaattaggaagaaaatggccaaagatactgtagtggtcagaacttatgtagaagatcaggaattccatatttcttcctttgaagagagacttattaaagaaattgaatatagaataataaagactacattagaagaacttcttgaagaagatggagaagaaaagatggcagttgacatttctgaatctgaagctgttgaatcaggatttgattcaagaatcaagaattatagaattcttgaggggatgggtgtcacttttcattgcaagatgtctggatatccattaccaaagattgcttggtacaaagatggcaagcgcatcaaacatggagaaagataccaaatggactttctacaagatggcagagctagtctgcgtatacctgttgttcttccagaagatgaaggaatctacactgcatttgccagcaatattaaaggaaatgcaatttgctcagggaaattgtatgtggagcctgctgcaccacttggagctccgacttacattcccacactagagccagtgagcagaatcagatctctctctccacgttcagtgagcaggtctcctatacgcatgtctcctgcacggatgtcacctgcaaggatgtctcctgcacggatgtcccctgcaagaatgtcccctggacgtaggctggaggagacagatgagtcacaacttgagagactatataaaccagtctttgtgttaaaacctgtttctttcaaatgtttagaagggcaaactgccagatttgacttaaaggttgttggtagacctatgccagagacgttctggtttcatgatggccagcaaattgtcaatgactatacccataaagtagtcattaaagaagatggtactcaatcactaattattgtccctgccacacccagtgattctggggaatggactgtggttgcccaaaacagggcaggcagatcttcaatttcagtgattttaactgtggaagctgtggaacatcaggtaaaaccgatgtttgtagaaaaactgaaaaatgtcaatataaaggaaggttcccgacttgaaatgaaagtcagagctacgggtaaccccaaccctgacattgtatggttgaaaaacagtgacatcattgtgcctcataaatatcccaaaatcagaattgaaggaaccaagggagaagctgcccttaaaatcgattccactgtcagccaagattctgcctggtatactgcgactgctattaataaagctggcagagacactacaagatgcaaagtaaatgttgaagttgagtttgcagagcctgagccagagagaaagttaatcatcccacgggggacatatagagcaaaggagattgcagccccagaactggagcccctccatttgcgatatggccaagagcaatgggaagaaggtgatctctatgacaaagagaaacaacagaaaccatttttcaagaaaaaactcacttccttaagacttaagcgctttgggcctgcccactttgaatgcaggctaacacccattggtgacccaacgatggtggtggagtggctccatgatggaaagccacttgaagcagccaacaggctccgtatgatcaatgaatttgggtactgcagccttgattatggcgttgcatattctagagacagtggtatcattacttgcagagccactaacaaatatggaacagatcacacatctgctacccttattgttaaagatgagaaaagtcttgtggaagaatcccaattgcctgaggggaggaaaggcttacagagaattgaagaattagagagaatggctcatgaaggtgcacttacaggtgtaacaacagatcagaaagaaaagcaaaagccagacattgtcttgtacccagagccagttagagtacttgaaggggagactgcaaggttccgctgcagggtaacaggctaccctcagcccaaagtcaactggtacctcaatggacagctcatccgcaaaagcaaaaggttcagagttcgctatgatggtatccattacctggacatcgtggactgcaaatcatatgacacaggtgaagtgaaggtcaccgcggaaaatcctgaaggtgtgatagagcataaagtgaagcttgagattcaacagagggaagattttaggtctgtccttaggagagctcctgaaccaaggcctgagtttcacgtacatgaaccaggaaagcttcagtttgaagtacaaaaagtggatagacctgttgacaccactgaaaccaaagaagttgtgaagttgaaaagggctgaaagaattacccatgaaaaagtgcctgaagagtcggaagagctgcgcagtaaattcaagcgcagaacagaagagggctattatgaagccattaccgctgtggagctcaagtctcgaaagaaggatgaatcctatgaggaactcctcaggaagacaaaagatgaacttctccactggaccaaagagttaactgaagaggaaaagaaagctcttgccgaagaaggcaaaatcacgattccaacttttaaacctgacaagattgaactaagtcctagtatggaggctccaaaaatcttcgaaagaatccagagccaaacagtgggccaaggatctgatgcacacttccgggtcagagtcgtggggaaaccagaccccgaatgtgaatggtacaaaaatggtgtcaaaattgaacggtctgaccggatctactggtactggcccgaagacaatgtttgtgaattggtcataagagatgtgactgctgaggactctgccagcatcatggtaaaagccatcaacatagctggagaaacctccagtcacgcattcttacttgtccaagccaagcaattgatcactttcacacaggaattacaagatgttgttgctaaggaaaaagacactatggcaacctttgaatgtgaaacttcagaaccatttgtcaaagtgaaatggtataaagatggtatggaggttcatgagggagataaatacaggatgcactctgacagaaaggttcacttcctctccatactgaccattgatacgtctgatgctgaagattacagctgtgtacttgtggaagatgaaaatgtcaaaacgactgctaaacttattgttgaaggtgcagttgttgagtttgtgaaagaacttcaggacatagaagttccagaatcatattcaggagaattagagtgcattgtatccccagaaaatatagaaggaaaatggtatcataatgatgtggagcttaaatccaatggcaaatatacaattacatctcgtcgtggacgtcagaacctcacggtcaaggatgtaaccaaggaggaccagggagaatacagctttgtcatcgacgggaaaaagacaacctgtaaattaaagatgaaaccccgccccattgctatcctacaaggacttagtgaccaaaaagtctgtgagggtgacattgttcagcttgaagttaaagtctccttggaaagtgtggaaggcgtctggatgaaagacggccaagaagtgcagcccagtgacagggttcacattgtgatagacaaacaatctcatatgctgctcattgaagacatgactaaggaagatgctggaaattactctttcaccattccagcccttggcctctccaccagtgggcgtgtctctgtctatagtgtggacgtgataacacctctaaaagatgttaatgtgattgaaggcaccaaggctgtgcttgaatgtaaggtgtcagtccctgatgtgacttctgttaagtggtacttaaatgatgaacaaatcaagcctgatgaccgtgtacaggccattgtgaaaggtactaaacagcgactagtcattaaccgaactcatgcttcagacgaaggaccttacaagctgatagttggcagagttgaaaccaactgtaatctctctgtagaaaaaattaaaattatcagaggtcttcgtgaccttacctgtacagaaactcaaaatgtggtgtttgaggttgagctgtcccactctggaattgatgtcctgtggaattttaaggacaaggaaatcaagcccagttctaaatataaaattgaagcacatggaaaaatatataaattgacagttctaaatatgatgaaagatgatgaaggaaaatacacattttacgcgggagaaaatatgacatctggaaaacttactgtggcaggtggggccatctccaagccactcacagatcagaccgtagctgaatcccaggaagctgtgtttgaatgtgaagttgccaacccagattccaaaggcgaatggttgagggatggcaaacacctaccactgactaacaacatcagaagtgagtctgatggccacaaaaggagacttatcattgctgccaccaaattagatgacattggagaatatacctacaaggtggccacctccaaaacatctgccaaactcaaagttgaagctgtcaaaattaagaagactctgaagaacctcacagtgacagaaacacaggatgctgttttcactgtcgagcttacacaccctaatgtcaaaggtgtccagtggatcaaaaatggagttgtgctggaatccaatgaaaagtatgctatctctgtcaaaggaacaatttactctctgaggattaaaaactgtgccatcgtggatgagtctgtttatggcttcaggcttggaaggcttggagccagtgccagactgcacgtggagactgtcaagatcattaaaaagccaaaggatgtgacagccttggaaaatgccactgttgcctttgaagttagtgtttcccatgacactgttccagtaaaatggttccataagagtgtggaaattaagccaagtgacaaacacagactggtctcagaaaggaaagtccacaagctgatgctgcagaacatctccccctcagatgctggggaatacacagctgtggtcgggcaattggaatgcaaagcaaaactgtttgtggagacattacatattacaaaaaccatgaaaaatatcgaggtgcctgagaccaaaactgcctcttttgagtgtgaggtgtcccacttcaatgtcccttccatgtggctgaagaatggtgtggaaattgagatgagtgaaaagttcaagatagttgtgcagggaaaactccatcagctgatcatcatgaacaccagcacagaggactcggcagaatacacatttgtctgtggcaatgaccaagtcagtgccaccctgacagtcaccccaatcatgattacttccatgctgaaagacatcaacgctgaagaaaaagacactattacttttgaggtgacagtgaactatgaaggcatctcttacaaatggttaaagaatggtgtggaaatcaaatcaactgacaagtgccagatgagaaccaaaaagctcacacactcactgaacatcaggaatgttcactttggggatgctgctgactacacctttgtggctggaaaagcaacatcaacagccacactttatgtggaagctcgtcatatagaatttaggaaacacattaaggacattaaggtactggagaagaagcgagccatgtttgaatgtgaagtttctgaacctgacatcactgtacagtggatgaaagatgaccaggaactgcagatcacagacagaataaagattcagaaggagaaatatgtccaccgccttctgatcccatccacccggatgtctgatgctgggaagtacacagtggtggcaggaggcaacgtgtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccgtgatatccggaagaccacagcccaaaatttcctggtacaaggaagagcagctgctttccactggcttcaagtgcaaatttcttcatgatgggcaagaatacacgcttttgctaattgaagccttcccagaggatgcggcagtctatacctgtgaagccaagaatgactatggtgttgccacaacatcagcttcactctcagtggaagttccagaagttgtgtctcctgatcaggaaatgcctgtttatccacctgccatcatcaccccgcttcaggacactgtcacttctgaagggcagccagcccgttttcaatgccgggtttctggaacagatctaaaagtgtcgtggtacagcaaagacaagaaaatcaagccatctcggttctttagaatgactcaatttgaagacacttatcaactggaaattgccgaagcttatccagaagatgaaggaacttacacgtttgttgctagtaatgctgtaggccaagtatcaagcacagccaacctgagtctggaagctcctgaatcaattttgcatgagaggattgaacaagagattgagatggaaatgaaagaattattctctgagggggaatctgaacattcagaaagggatacacgtgacgccttttcagattctgaagacatagaccacaaatccatggctgctaaaagatatgcaagtagaatatcatctacaagctcctggcctgaatattttaagccttcttttacccagaaacttacatttaaatatgttttagagggtgaaccggttgtttttacatgtagattaattgcctgtccaactccagaaatgacttggtttcataacaatcggcccatcccaacaggtcttcgtcggattataaaagctgagagtgatttacaccatcactcttccagcttagagattaaaagggtccaagacagagattctggaagttataggttactagcaattaatagtgaagggtctgcagaatcaactgcatcattgcttgttatccaaaaagggcaagatgagaaatatttagaatttctgaaaagagcagaacggacacatgaaaatgtggaggctttagttgaaaggggagaagataggataaaggttgacctgaggtttactggctctccctttaacaaaaaacaagatgtggaacaaaagggaatgatgagaactatacattttaagacaatgagttctgccaagaaaacagattacatgtatgatgaagaatatttagaaagtaaatctgacataagaggttggcttaatgtaggtgaaagtttcctggacaaggagaccaaagtgaagttgcaacgtttaagggaggctagaaaaacattaatggagaaaaagaaattatctcttttagatacgtcttctgaaataagctcaagaactttgagaagtgaagctagtgataaagatattctgttctctagagaggacatgaaaatcagatctatgtctgatctagctgaaagttataaggtagatcattcagctgagagtattgtgcaaaatccacatgccctttctaatcaaatggatcaaaatatagaatctgaggaacttcccacaagctttcaaactattgttgatgaagaaattttccagactgaaataagaatgagccaagaagcactggtaaaggaaagtctaccaaaagaccatttatatggtgaaattctagtaaatgaaaatacccaagcaagaggacagctggaagaaattatggccaatactacaattggagagtcatccacatatatcactaatgtatgtgagaaggaggaagtatatgagactcctgaaaatgtgtctcaagctattacaccacatgccagcgaatcttttggtacacttgtaaatgttgaagaaagtgaagaaatagctagtgaaagaataaaaaaggatgatttgagagaattacaactctctgcttctacacgaattgatgaattcaaaaccgaacagaaggaagaaaacatgagattttttgaaaattcttttcgaaaacgcccacaacgttgcccaccttcatttcttcaagaaattgaatctcaagaagtttatgaaggtgacagttgtaattttgtgtgtcattttcaaggatatcctcaacctatagtgacgtggtataacaatgacatgccaatcccacgtaatcaaaactttatcattcattcgttggaaaactattcaatattaactctttcatctgttcatcatcagaatgaaggttctattacttgtgtgctatttaaccaatatggaacagtaaaaacaaccagtatgcttaaagtgaaagcaaaacaaaaacatgatgtcaaagcacataaagtcccagtgttccatgactacttggatgaggaagaagagttagcattggtgtttgaccaagcaaaaggcgcccatccatctatgagtcaagagggccaaacaaatcttcatttgttaaaaactaacccaccagttcctccctctggagacacagaattgctttcctttcctgtagaaattcaggtaacagcagctactcctatcccagaacaggataaagagtctaaagaagtgtttcaaactgaggagctggaacctaaagcaatgcctcaagatcaagttactcaatcaccaaaacacagatttgtatttttgtctgatattactaatgaaccaccaaaaatgttacaagaaatgccaaagcatgccaggtgtagagaaggggattccatcattcttgaatgtttaatatctggtgagccccagccagttgtaacatggtttcaaaatggagtccttttaaagcagaaccagaagtttcagtttgaagaagttaattgtagccaccaattatatattaaggatgttaattctcaagattctggaaaatataaatgtgttgctgaaaacaattcaggggcagttgaaagtgtttcagatctaacagtggagcctgtcacttatagagaaaatagtcaattcgaaaatattggtgaaatttatggaaaatattccagagatcagcaactgcaagaccagggagaatctgtaagggcacatttttatgattatccagctggtccctttactccctggacaaatgtaaaagaatattcagtaagggactattttcaaagccttgagactattgagcaaatagaccagaaagagcaggtgcgttgcataccttctagagaaaaaattcccagatttgtgcatggtgcttcaagaaccataaaaatcagcaagcccatcagggctgaattcatacaatgtcaggctgaagggaaagagagacatgtaagtgaaaaatcaaagctgcaccaagcagagggtactgtttatccatttgttgatgatttcagtgatgtcactattaagaaagaaataagaaataattttggaaaacttggtagatcagaaaaggaaaatgtacaagaatgtgcccaaagtgactatttaccaaatattcactctgagagaatttctgacagttacaatacaaaagattcatctgccattgtatatgaagaatcccttggtgaagagatacactacccggggaaaaaggtgaagcatagaattatcgaatttgaaaaattacatgtagaaaaaggagttctagaaaaaagacctaccagaacatcaattgttaatcctcctcaaaagaagattgatgacaaagccttttcattaaagcaaagagaatcaagatcaagcaatctaaatgcaaatatgtatcaggcagagaaaatgtctccaaatactgaatcagattcatctaacattgcaataaatttaaagctgctttcctctcaaactcataaagaatttgacgcacaagaaagggaacaacaggaaaaaataagtcttatagataaacctgcaatttctaaaagagctgaacatgaatcacctattacatttgacttaaagcagtttcacactcaaataaaacacacagatgtgaaattccaagaattagatagtggtcaaccagaagaagcttattttaaaatccaacatcctgctgacactgagaacattgtatttgatctaaaacaaatgtattctcatataggagatccagctctggagttccaagggcaagaaactagggaacagcaggaaatacattataaagaaaaaattcctagccctgaaacgttacaacctgacacacacaatatctctaaaagtgtgcaaaataatgtatttgccagtcaagaaatttcttccagtcaagagctttcaaatagaactatggtggagaaaagtagtattgatgaaaattccatttctttagaaaaagaagtccgacatgtacaggaacaaaacttagacattttaaaaactgatctttctcttaaatccttttctgaagaaatctatagtgaatcatgtgccctacttccaacctcatctgcagatatagaagaaactgatctttctgagaaaagttgtcctctagaaaatggaggcagaagttccatctcacatttgaaaaaagcagcaagtgaggaaaagcctttaggggttggtgaaatggaagaagaatgcactctagaaccagagttggcagcatttccaaagcaggatggtgggacacaggaatatacagatgccactttggaagaccacagaggtgatgttcaggaagctgacacactccatagacagctctccctgagtcagtgcttcccactcttgatgactgaagaacaacagaatccaggtgaacaaataagtacaaacattcatgcctctggagaagaaaaatgttatgaagaagttcaagttcagaatgaagcttctttctccactttagaaggagaaatgatagaaactagtttttctcaaaatattcctaaattagatgaggcacataccactgaggcagcagaatctgagacctccctaacacaatatttacttgctgctggaaagcgtgaggttcctgaaactaaagacaccagagaccaggcaaagcttgtccagagtgaatcaatcacttcaatggaggtggaagaagtaactttcaacactgtgtatgaatactacaaccagaaacaggaatcactaggtcgtccactttctcctgagtctgacatttccattggtgtgggaagtacaaccagtgaagaaatatctgagttagatcagttttataccccaccatcatctgttgaatattttgaatctccaaagtcccctgacttatattttaatccttcagatataactaaacaatcctcaatacattcaggaggtgagacagttgaaagatattccacacctttaggggaagttgctgaaagatattcaacaccttccgaaggtgaggtaggagaaagatactccacacccccaggggagacactagagagatactccacacctccaggagagactctagagagatactccacacccccaggagagactctagagagatattccacacccccaggagagactctggagagatactccacacccccaggagagactctagagcgatattccacacccccaggggaggcactagagagatattctattcctactggaggaccaaaccccactggtacttttaaaacatatccatcaaaaatagaaagggaagacggtacaccaaatgagcatttctacacacctacagaagagaggggttcagcttatgaaatatggcgttccgattcatttggtacacccaatgaagccattgagccaaaagacaatgaaatgcctccatcttttattgaacctctgaccaaaaggaaggtatatgaaaacacaacactaggcttcattgttgaagttgaaggtcttccagttcctggtgtgaaatggtatcgaaataaatctttactagagccagatgaaagaatcaaaatggaaagagtgggtaatgtgtgttcactggaaatttctaacattcaaaaaggagaagggggagagtacatgtgtcatgctgtaaacatcataggggaagcaaagagctttgcaaatgtagacataatgccccaggaagaaagagtggtggcactaccacctccagtaacacatcagcatgtcatggagtttgatttggaacacaccacatcatcaagaacaccttctcctcaagaaattgtcctggaagttgaattaagtgaaaaagacgttaaagaatttgagaagcaggtgaaaatagtgacagttcccgaatttactcctgaccataaaagtatgattgtgagtctagatgttcttccatttaattttgtagatccaaatatggattcaagggagggagaagacaaagaactaaaaattgatttagaagtatttgaaatgcctcctcgctttataatgcctatttgtgattttaaaattccagaaaattcagatgctgtattcaaatgttcagtcatagggatcccgactcccgaagttaagtggtataaagaatatatgtgtattgagccagataatattaaatacgtgattagcgaggagaagggaagtcacactcttaaaattcgaaatgtctgtctttctgatagtgcaacatacaggtgcagagctgtgaattgtgtaggagaggctatctgtcggggattcctcaccatgggagattctgaaatatttgctgtgatagcaaagaaaagcaaagtgactttaagcagtttaatggaagaattggtcttaaagagcaactacacagacagtttttttgaatttcaggtggtggaagggcctcccaggtttatcaaaggtatttctgactgttatgcaccaataggtacagcagcatattttcagtgcttagttcgtggctctccaagacccacggtttactggtacaaagatggaaaattagtccaaggaagaaggttcactgttgaggaaagtggcacagggttccataacctgtttataacaagcttagtaaagagtgatgaaggagagtataggtgtgtagctacaaacaaatcaggaatggctgagagctttgcagcactcaccttaacttaaaatgtaatgttttagtgcctcagtaattattagcattgatctgagtgctttcatattttccaaattatgtggatctaataaacttccaaacaggtccaccatatttgaattcattaccttggagacccctaaagaaataatctctatgtagaaatctcatctttgtaatacatgtaaatattttgttatctgaactgtggaatcatcacttgtgtcaatcatgctgtgtaatatcaaacacaattaaatctctccttggctacct

SEQ ID NO: 31720 - DNA, 2483 bp, Homo sapiens
aagaattcatcaaattagaacaacatagagttgaagaagaacacagagttgaaaaagttcatagggtaatagaagtttttgaggctgaagaagtggaagtatttgaaaaaccaaaagctccacctaaagggcctgagatatctgagaaaatcatccctccaaaaaaaccgcccactaaagttgttcctcgaaaagagccaccagctaaagtaccggaggtgcctaagaaaattgtggtagaagaaaaagtacgtgttcctgaagagcccagagttccaccaactaaagcacccgaagtacccaagaaaattgtcccagaagaaaaagttcgtgaagctgttctgaaaaagcctgaagttccaccagctaaagttcctgggatgcctaagaaaagtgttcaagaagaaaaatcacctattgttatttctgaagacacagagatgtacatttatgaagcatctgaagaagcagtcctagaagaaaaagtacttgtgactcaacctcaaaagacaaaacccaaactagcaaaagtgcctgagccacccaagaaagttgttccagaagacaaaatatatgtgactattcctaaaaagagagaaacaccagcaactaaagaacctgatacaaccagaggcatttttccagaggtggagccacctgaggctattcctgaaattccagaacatcctccaactgaagagtttgaagtcttcaaggaagtcattccagagggagaaactcctattgttaaaagaagaaaaacaccatcaccaacagcaccagaagctatgaaagaagttgtccctgaaatgaaaatatttgaggatgtacctgaagagccagaaactccacgtatgaaaacgcccgaagctcctcaagaaattattcctgccaagacagttccttccaaaaaaagagaacccccatcagttaaagtgcctgaagctctccaagaaattgtccctgaaaagaaaacgcttgtggttcctctcagaaagcctgaagtccttcctgatgaagtgccggaggctctcagagaagttgtcccggaaaagaaagtgcatcctccccaaagggctgaagttgtacctgtcaaagtgcacgaagctcccaaagagattatccctgaaaagaaagtgtcggtggtgcctcctaaaaagcctgaagtcccacctgttaaagtgccagaagcttccaaagaggttatccgcgaagagaaagtgcccttggctcctcctaaagagcctgaagtcccacctgttaaagtaccagagcctcccaaagaagtagttcctgaaaagaaagcgccagtggctcctcctaaagagcctgaagtcccacctgttaaagtgcctgaggctcccaaagaagttgttcctgaaaagaaagtgccagtgcctcctcctaaaaagcctgaagtgccacccacaaaagtcccagaggtgccaaaggcagctgtcccagaaaagaagttgcctgaagctattcctcccaaaccggaaagtcctccccctgaagtgcctgaagtgctgccaccgaaggaagtggtcccagaaaagaaagtaccggtgcctcctgccaaaaagccagaagctccacctcctaaagttcctgaagctcctaaagaagttgtacttgaaaagaaagcatctgtggctgtgcccaaaaaaccggaagccccacgtgcaaaagtgcctgaagctgctcaagaagttgtcccagaaaagaaaattcccaaggcaccaatcaaaaaaccagaagcccccgcagttacagtgcctgaagtcccacaagaaattgtgccagaaaagaaaacactggtgcttcctaaaaagccagaagttccacctgttacagtgccagaggctcccaaagaagttgtccttgaaaagaaagtgccctcggctcctcctaaaaagcctgaagtcccacctgttaaagtgcctgaggctcccaaagaagttgttcctgaaaagaaagtgccagtgcctcctcctaaaaagcctgaagtgccacccacaaaagtcccagaggtgccaaaggcagctgtcccagaaaagaaggtgcctgaagctattcctcccaaaccggaaagtcctccccctgaagtgcctgaagtgctgccaccgaaggaagtggtcccagaaaagaaagtaccggtgcctcctgccaaaaagccagaagctccacctcctaaagttcctgaagctcctaaagaagttgtacttgaaaagaaagcatctgtggctgtgcccaaaaaaccggaagccccacgtgcaaaagtgcctgaagctgctcaagaagttgtcccagaaaagaaaattcccaaggcaccaatcaaaaaaccagaagcccccgcagttacagtgccagaagttcctcaagaagccgcagaaaaagaaattcccgtggctccacccaaaaaaccagaagctccgattgtcccagtgcctgaagctcaagaagttgtcccagaaaagaaa

SEQ ID NO: 31721 - DNA, 1285 bp, Homo sapiens
gttgttcctgaaaagaaggtgcctctggtggttcccaaaaagccagaagccccacctgctaaagtgcctgaagttccaaaagaagttgttccagaaaagaaagtagctgttcccaaaaagccagaagtcccaccagcaaaagtgccagaagtgccaaagaaacctgtcttggaagagaaaccagctgttcctgttccagaaagagcggagtctcctcccccagaagtatatgaagaacctgaggaaattgctcctgaagaggaaattgctcctgaagaggaaaagccagttcctgttgcagaagaggaggaaccagaggttccacctccagcagtgcctgaagagcccaagaagatcatcccagagaagaaagttcctgtcatcaaaaaaccagaagcaccgcctcctaaagaacctgagatgccaaagaaagttgttccagtgaagaaggtcccaactgttaagaagccagaaacaccagcagctaaagtgcctgaggtgcccaagaaacttgttccagtaaagaaagaacctgtgcctgttaccaaaaaaccagaagttcttccagaaaaagtgcccaaagtgcctgagaaaatcatcccagaaaaggaagtgtctgtgcctatccctgcagagccagaagttccacctgctgaagttgaagagactcctgaggaaataatatatgaagaaaaagcatctataaccattggtagaaaagagactccccctgttgaagaacgtgaaattgaaaagtatattaaacctgaagagcccgaacctgaaccacagcctgaagaaataccagtaaaagaacctgaacctgaaaaggttattgagaagccaaaactcaaaccaagacccccacctcctccacctgctccacctaaggaagatgtgaaggagaaaatattccaacttaaagctattccaaagaagaaagttcctgaaaaacctcaggttccagaaaaagtggagcttacacctctgaaagtaccagaaccaccacctccaaaacctgttgaagaggttgaagtacctactgttacaaaaagggaaaggaagattcctgaaccaacaaaagtgcctgaaatcaagccagcaatacctctccctgcacctgaaccgaaaccaaagcccgaagcagaagtgaaaacaatcaaaccacctcctgtggaacctgaaccaacccccatcgctgccccagtaacagtgccagtggttggaaagaaagcaggtgtacccaaaaagactccttcaccaatagaagccgaaaggagaaagt

SEQ ID NO: 31722 - DNA, 540 bp, Homo sapiens
aaagtgccagaagtgccaaagaaacctgtcttggaagagaaaccagctgttcctgttccagaaagagcggagtctcctcccccagaagtatatgaagaacctgaggaaattgctcctgaagaggaaattgctcctgaagaggaaaagccagttcctgttgcagaagaggaggaaccagaggttccacctccagcagtgcctgaagagcccaagaagatcatcccagagaagaaagttcctgtcatcaaaaaaccagaagcaccgcctcctaaagaacctgaacctgaaaaggttattgagaagccaaaactcaaaccaagacccccacctcctccacctgctccacctaaggaagatgtgaaggagaaaatattccaacttaaagctattccaaagaagaaagttcctgaaaaacctcaggttccagaaaaagtggagcttacacctctgaaagtgcctggaggtgaaaagaaagttcgcaaattacttccggaacgtaaacctgaaccaaaggaagaagttgttctgaaaagcggtata

SEQ ID NO: 31723 - DNA, 436 bp, Homo sapiens
gaagacacttatcaactggaaattgccgaagcttatccagaagatgaaggaacttacacgtttgttgctagtaatgctgtaggccaagtatcaagcacagccaacctgagtctggaagctcctgaatcaattttgcatgagaggattgaacaagagattgagatggaaatgaaagaattattctctgagggggaatctgaacattcagaaagggatacacgtgacgccttttcagattctgaagacatagaccacaaatccatggctgctaaaagatatgcaagtagaatatcatctacaagctcctggcctgaatattttaagccttcttttacccagaaacttacatttaaatatgttttagagggtgaaccggttgtttttacatgtagattaattgcctgtccaactccagaaatgacttggtttcataaca

SEQ ID NO: 31724 - DNA, 1885 bp, Homo sapiens
taaattgaccattgcagatgttcgagcagaagaccagggtcagtacacctgcaaatatgaagaccttgaaacttcagcagaactcagaatcgaagctgaaccaattcagtttacaaagcgcatacagaacatcgtggtgagtgagcatcagtctgccacctttgagtgtgaagtgtcctttgatgatgccattgtaacatggtacaaaggaccaacagaactgacagagagccagaaatacaacttcaggaatgatggccgctgccattatatgaccatccacaatgtgaccccagacgatgaaggtgtctactcggtcatcgctcggctggagccaagaggtgaagcaagaagcacggcagagctgtacctaacgacgaaagaaatcaaacttgagctgaagcctcctgatattcctgactccagagttccaatcccaaccatgcctatcagagcagtgccaccagaagaaatccctcctgtggttgctcctcctatcccccttttgctaccaacacccgaagaaaagaaaccaccaccaaaacgtattgaagttaccaaaaaggctgtgaagaaagatgccaaaaaagttgttgcaaagcccaaagagatgacaccacgtgaagagattgtcaagaagcctccacctcctactaccttaattccagcaaaagctcctgaaatcattgatgtatcctctaaagctgaagaagtaaaaataatgactataaccagaaagaaagaggttcagaaagaaaaagaagctgtgtatgagaaaaagcaagcagtccacaaggagaagagagtcttcattgaatctttcgaagaaccttatgacgaactggaggtagaaccatacacagagccatttgaacaaccttattatgaagaaccagatgaagactatgaagagattaaggtagaagctaaaaaagaagttcacgaggaatgggaagaagattttgaagaagggcaagaatactatgaaagggaagaaggctatgacgaaggggaggaagagtgggaagaggcttaccaagaaagggaagtaattcaagttcaaaaggaggtctatgaagaatcacatgagagaaaagttccagccaaagtacctgaaaagaaagcaccaccacctcctaaagttataaagaagccagtaattgaaaaaattgaaaagacttctcgaagaatggaggaagaaaaagttcaagtcaccaaagtacctgaagtttcaaagaagattgttccacaaaaaccttcccggactccagtacaggaagaagttattgaagtgaaagtaccagctgtgcatacaaagaagatggttatttcagaagaaaagatgttctttgcttctcacacagaggaggaggtgtcagtcacagtccccgaggtacaaaaggaaattgttactgaagagaaaattcacgttgccatttccaaaagggttgaaccaccacctaaagtccctgagctacctgagaaaccagctccagaagaagtggcccctgttcctatccctaaaaaagtggagcccccagcaccaaaagttcctgaggttcccaagaaacccgtgccagaggagaaaaagccagttcctgtgcctaagaaggaacctgctgctcccccaaaagtcccagaggtgccaaagaaacctgtccctgaagaaaagattcccgttcctgttgcaaagaaaaaggaagctcccccagctaaagtgccagaaataccaaagaagaaagttcctgaagaaaggaaacctgttcctcggaaggaggaagaagttccaccaccaccaaaagtgccagctctgcctaagaaacccgtcccagaggagaaagttgcagtgccagttcctgtcgctaagaaagctcctcctccccga

SEQ ID NO: 31725 - DNA, 2793 bp, Homo sapiens
gtagaagaattcatcaaattagaacaacatagagttgaagaagaacacagagttgaaaaagttcatagggtaatagaagtttttgaggctgaagaagtggaagtatttgaaaaaccaaaagctccacctaaagggcctgagatatctgagaaaatcatccctccaaaaaaaccgcccactaaagttgttcctcgaaaagagccaccagctaaagtaccggaggtgcctaagaaaattgtggtagaagaaaaagtacgtgttcctgaagagcccagagttccaccaactaaagcacccgaagtacccaagaaaattgtcccagaagaaaaagttcgtgaagctgttctgaaaaagcctgaagttccaccagctaaagttcctgggatgcctaagaaaagtgttcaagaagaaaaatcacctattgttatttctgaagacacagagatgtacatttatgaagcatctgaagaagcagtcctagaagaaaaagtacttgtgactcaacctcaaaagacaaaacccaaactagcaaaagtgcctgagccacccaagaaagttgttccagaagacaaaatatatgtgactattcctaaaaagagagaaacaccagcaactaaagaacctgatacaaccagaggcatttttccagaggtggagccacctgaggctattcctgaaattccagaacatcctccaactgaagagtttgaagtcttcaaggaagtcattccagagggagaaactcctattgttaaaagaagaaaaacaccatcaccaacagcaccagaagctatgaaagaagttgtccctgaaatgaaaatatttgaggatgtacctgaagagccagaaactccacgtatgaaaacgcccgaagctcctcaagaaattattcctgccaagacagttccttccaaaaaaagagaacccccatcagttaaagtgcctgaagctctccaagaaattgtccctgaaaagaaaacgcttgtggttcctctcagaaagcctgaagtccttcctgatgaagtgccggaggctctcagagaagttgtcccggaaaagaaagtgcatcctccccaaagggctgaagttgtacctgtcaaagtgcacgaagctcccaaagagattatccctgaaaagaaagtgtcggtggtgcctcctaaaaagcctgaagtcccacctgttaaagtgccagaagcttccaaagaggttatccgcgaagagaaagtgcccttggctcctcctaaagagcctgaagtcccacctgttaaagtaccagagcctcccaaagaagtagttcctgaaaagaaagcgccagtggctcctcctaaagagcctgaagtcccacctgttaaagtgcctgaggctcccaaagaagttgttcctgaaaagaaagtgccagtgcctcctcctaaaaagcctgaagtgccacccacaaaagtcccagaggtgccaaaggcagctgtcccagaaaagaagttgcctgaagctattcctcccaaaccggaaagtcctccccctgaagtgcctgaagtgctgccaccgaaggaagtggtcccagaaaagaaagtaccggtgcctcctgccaaaaagccagaagctccacctcctaaagttcctgaagctcctaaagaagttgtacttgaaaagaaagcatctgtggctgtgcccaaaaaaccggaagccccacgtgcaaaagtgcctgaagctgctcaagaagttgtcccagaaaagaaaattcccaaggcaccaatcaaaaaaccagaagcccccgcagttacagtgcctgaagtcccacaagaaattgtgccagaaaagaaaacactggtgcttcctaaaaagccagaagttccacctgttacagtgccagaggctcccaaagaagttgtccttgaaaagaaagtgccctcggctcctcctaaaaagcctgaagtcccacctgttaaagtgcctgaggctcccaaagaagttgttcctgaaaagaaagtgccagtgcctcctcctaaaaagcctgaagtgccacccacaaaagtcccagaggtgccaaaggcagctgtcccagaaaagaaggtgcctgaagctattcctcccaaaccggaaagtcctccccctgaagtgcctgaagtgctgccaccgaaggaagtggtcccagaaaagaaagtaccggtgcctcctgccaaaaagccagaagctccacctcctaaagttcctgaagctcctaaagaagttgtacttgaaaagaaagcatctgtggctgtgcccaaaaaaccggaagccccacgtgcaaaagtgcctgaagctgctcaagaagttgtcccagaaaagaaaattcccaaggcaccaatcaaaaaaccagaagcccccgcagttacagtgccagaagttcctcaagaagccgcagaaaaagaaattcccgtggctccacccaaaaaaccagaagctccgattgtcccagtgcctgaagctcaagaagttgtcccagaaaagaaagttcctaaggctcctcccacaaaaccagaagccccacctgccacagtgcctgaagtcccacaagaaattgtgccagaaaagaaaacactggtgcttcctaaaaagccagaagttccacctgttacagtgccagaggctcccaaagaagttgtccttgaaaagaaagtgcccttggctcctcctaaaaagcctgaagtcccacctgttaaagtgcctgaggctcccaaagaagttgttcctgaaaagaaagtgccagtgcctcctcctaaaaagcctgaagtgccacccacaaaagtcccagaggtg

SEQ ID NO: 31726 - DNA, 2123 bp, Homo sapiens
atatgaagaaccggggacagtgctcagtaatcaatagtctgcagttctgcacccacgtgctcctgggtactctgccgtccccacagggtcctcagctcagcccctgtcactgcctctcctgccaccctttgtccactcggcagtgttctcactcctcatccccccacacccaccacctgtctgccagcctcttgcaccatgagttgctactcctggggtgctggactgtccccacagccatctgtctcccctgctccccatgaagaagagccagtcccctcccaggtagcacatcagagcgggcaggctccagagctcttctggtcctcttgcagtggccagaaagtggggaaaggggcccagagaggggcagggactgacccatggtcacacagcctatttatggctgatctggagccaggccttctgactatcacccatcagagcccctggattcccatttcacccaacacaggtgttggggtagaactgggggccctccacccctactagcctgactgtctcctgagacctgtctcctaagaccacttacctgaccactggccatggggaaggaaaacacctggccaaggctcatgccccaggttcccaggcatgaagttgactgtctccgcccctgctggtgtggtgagggtgactggggactaggcactaggcctttggtgcaggcgcctgaggacgtggttgcactctcccttctggggatatgcccttgagcccaggcagaggagagcacagccagggcaggacctggcagccctggtacagagcccagagggggcatcagttcctgctggtcctgctctgtttacagacaagctgctgtcctccctgcaaaggggagtgggtggggcagagggcaagtgccaggggggcacaaggctgggcatgtggctggcatgagacggtgtctgagtaatgtcaggcacctggaggcattgaccccaggaccttggaccccagacctctgaccggggggcagccagcgtccaggtaccccaacccctgccctgggtccggcgtccccccattagtgagtcttggctctacttatagcatctgacaccagaggggccgaaaatagcccctggagaagggggaggagggggctatttaaagggcctgggaggggagagagaatgaggagtgatcatggctacctcagagctgagctgcgaggtgtcggaggagaactgtgagcgccgggaggccttctgggcagaatggaaggatctgacactgtccacacggcccgaggagggctgctccctgcatgaggaggacacccagagacatgagacctaccaccagcaggggcagtgccaggtgctggtgcagcgctcgccctggctgatgatgcggatgggcatcctcggccgtgggctgcaggagtaccagctgccctaccagcgggtactgccgctgcccatcttcacccctgccaagatgggcgccaccaaggaggagcgtgaggacacccccatccagcttcaggagctgctggcgctggagacagccctgggtggccagtgtgtggaccgccaggaggtggctgagatcacaaagcagctgccccctgtggtgcctgtcagcaagcccggtgcacttcgtcgctccctgtcccgctccatgtcccaggaagcacagagaggctgagagggactgtgacttgggctccgctgtgcccgccctgggctgggcccttcctggctaggactgtggaggggagctgctggccatggctgctttgtagtttgcccagagttgggggctaggggaggggggagccagaggccaggatgcctgagccccctgagttcccaaagggagggtggcagagacagtgggcactaagggtggagagttgggggccagcacagctgaggaccctcagccccaggagaagggacaaaaggtactggtgagggcaagaggtgcctgggaggagtggccctgatccaggaaaatgtgaggggaatctggaacgctctaggcagaagaagctgggagggagggggaggtgaaaagggcagaggcaaggatggtggggcccccagcaccctctgttagtgccgcaataaatgctcaatcatgtgccagag

SEQ ID NO: 31727 - DNA, 1381 bp, Homo sapiens
ggcaagatggcgggaggggtgctcccgctgaggggcctccgcgccttgtgtcgcgtgctgctcttcctctcgcagttctgcattctgtcgggcggtgagcaatcgcaggcgctggctcagtcaataaaggatccgggcccaacacgcacattcacagtagttcccagggcagcagaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaagaaa

SEQ ID NO: 31728 - DNA, 1329 bp, Homo sapiens
ccggcccggaagtgcgcaggcgctggcaagatggcgggaggggtgctcccgctgaggggcctccgcgccttgtgtcgcgtgctgctcttcctctcgcagttctgcattctgtcgggcggtgaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaagaaata

SEQ ID NO: 31729 - DNA, 6324 bp, Homo sapiens
gcggcgggggctgtgctggcgccggcaggcgcgaggaatcacagagcggggcgcccagcctcatcatggggcggcccacggagacttcccgtgggagtggggtctggtgcaggggcgccccaaaggacgagtgggagatggggacacgcggcgcagagagactcctcgtggatggagccgatggaggcccagtgtagaagagaaaggggtcaaggagacggataaggagccaccagagacgcggggggaattccccgcagaggatgcgggaagccggggaaaggaagggattccggaaggaagggctgagagccgggtcaggtgctggcaggagggctggttggatagaaactggggcgggcccagggcatttggcgtccccgacatgcgtatacacttggagagatgattccctggagatccaagtgcctgtatagacaatcttttctagaagttctaccgttaggtgaggcgagagtagatgtagaaattggagacgagaataaagagtgttttaaaagcgtgcgtggttacaggactggctctgggttcaggggtccccactcactagctgtgagaccttgaacaagtcgcttagcctctctgtgcctcagttttctcatctgtaaggtggggatgatgatggcaatacctgcttcacagagtgaaaattagatgagatgatgtctgtaaaattacgtaagacggtacccaaaagtagtactatttttcccttttcttattagagcaggttgcgcacgttttgatgtccgtgggaatgagcaggtagagagggtggtattgaggccggaggggagagaagggacccacagatggggagagaagtcttgggtgcctgttttatcccaaaccaggggaaggagggaacaggtagggctggctgcaggaaagcttgcaggtatggggtacacagttaaaagggagtgtcttctgatagtcttgatgcaggcctggaggtcgtttgttatgggggtggaggtcctgatgtacattgtggcggtaagatgccgtgctgtctttgccaccagcctgtggcagccctggtgttacaccagggcaggtgggcagtttaatgtatctcaggccagatgacctgccctgcccacctgttgaggctccagtagatagacgtgaaagcacagtataagcataatgcaccactttaatccttttctctgaggagctggaaggcctgtagtcaccatctgagccaaatgtcattcaagtacttcacttgggttacacaccacactttgacccactatctcatttagtcatcacaacaaatgggtgaaataggtattattgtcccattttacagatgcagaatctgagtttcagggaagttaaggactttgtcccagggcccacagttagtaagcagtggacccaggatttcaactcagctctgtctgacctcaaaacccatgatctgaaaccactgtgaaagtttgcaaaacctctgtagcagccaagcaggatggaaagatgtgtagggattgtcttctccatttgatagatgagacaagagctgggtactctgatctccatcccaagcacacagagcttggggccccacagccctggtgtgaatcccactccactaccagaggctgtgtgcctttggaccaggcatcttgcttctctgaccctatatacagctgcagaagaattccttgcaggttgctgtaaggatttggagggaaactgttgcccagcacacagtacacattctgggagccatcgtttccccagtgcacttttcctgcaaatgtggatctacatcccacttggatgctgagaccagctgctgtgatcttgcatttgtttagcgctttgttctccttgaggcagtaaagtggtggcacctgaccggagcatgtagccacctatgacttcctgagtggggtggtgtggggagggccctgaggagtctgtggtcctaggccttggatttcatcagggctttcctgctccttctggttgcctcagtcccaggcaagatagggtcccagaatcttacagcccagaggccacctgttgcaacttcttttttacagatggagtcatcagaacccactgtgaggaagtgacttctccttgaggtcacccagacactccaaacagagcagagcaaaagcgcctagaacttgaaattttggacctgtctccaacaccctggggatttccaccaggaagccttcagtcaccatccaggggatttttatcgccacaaagggtaattcctgctccatccctgctgtgactcagctgtgacgttgaaccacacaagccagagagaagaagataaagtcatcagagctcctactcaccagagagtgaggcccaggccaggactccacaaggctggtcccctgccctggagcaacttaaacaggccctctggccagcctggaaccctgagatggcctccagctcaggcagcagtcctcgcccggcccctgatgagaatgagtttccctttgggtgccctcccaccgtctgccaggacccaaaggagcccagggctctctgctgtgcaggctgtctctctgagaacccgaggaatggcgaggatcagatctgccccaaatgcagaggggaagacctccagtctataagcccaggaagccgtcttcgaactcaggagaaggctcaccccgaggtggctgaggctggaattgggtgcccctttgcaggtgtcggctgctccttcaagggaagcccacagtctgtgcaagagcatgaggtcacctcccagacctcccacctaaacctgctgttggggttcatgaaacagtggaaggcccggctgggctgtggcctggagtctgggcccatggccctggagcagaacctgtcagacctgcagctgcaggcagccgtggaagtggcgggggacctggaggtcgattgctaccgggcaccctgctccgagagccaggaggagctggccctgcagcacttcatgaaggagaagcttctggctgagctggaggggaagctgcgtgtgtttgagaacattgttgctgtcctcaacaaggaggtggaggcctcccacctggccctggccacctctatccaccagagccagctggaccgtgagcgcatcctgagcttggagcagagggtggtggagcttcagcagaccctggcccagaaagaccaggccctgggcaagctggagcagagcttgcgcctcatggaggaggcctccttcgatggcactttcctgtggaagatcaccaatgtcaccaggcggtgccatgagtcggcctgtggcaggaccgtcagcctcttctccccagccttctacactgccaagtatggctacaagttgtgcctgcggctgtacctgaatggagatggcactggaaagagaacccatctgtcgctcttcatcgtgatcatgagaggggagtatgatgcgctgctgccgtggcccttccggaacaaggtcaccttcatgctgctggaccagaacaaccgtgagcacgccattgacgccttccggcctgacctaagctcagcgtccttccagaggccccagagtgaaaccaacgtggccagtggatgcccactcttcttccccctcagcaaactgcagtcacccaagcacgcctacgtgaaggacgacacaatgttcctcaagtgcattgtggagaccagcacttagggtgggcggggctcctgagggagctccaactcagaagggagctagccagaggactgtgatgccctgcccttggcacccaagacctcagggcacaaagatgggtgaaggctggcatgatccaagcaagactgaggggtcgacttcgggctggccatctggttaggatggcaggacgtgggctgggcccacaaaggcaaagggtccagaaggagacaggcagagctgctcccctctgcacggaccatgcgacactgggaggccagtgagccactccggccccgaatgttgaggtggactctcaccaaatgagaagaaaatggaaccaggcttggaaccgtaggacccaagcagagaagctctcgggctaggaagatctctgcagggccgccagggagacctggacacaggcctgctctctttttctccagggtcagaaacaggaccgggtggaagggatggggtgccagtttgaatgcagtctgtccaggctcgtcattggaggtgaacaagcaaacccagacggctccactaggacttcaaattgggggttggatttgaagacttttaagtttccttccagcccagaaagtctctcattctaggcctcctggcccaggtgagtcctagagctacaggggttctggaaacattcaggagcttcctgtcctcccagctcctcactcaccttcagtaacccccactggactgacctggtccacagggcacctgccaccctgggcctggcagctcagcttccccaacacgcaggagcacacccagcccccacatcctgtgcctccatcagctaaacaccacgtcacttcatgcaggtgaaacccagtcactgtgagctcccaggtgcagccagaggcacctcaagaagaagaggggcataaactttcctcttcctgcctagaggccccacctttggtgctttccagaatcccgtaacacctgattaactgaggcatccacttctttcagcagactgatcaggacctccaagccactgagcaatgtataaccccaaagaaataatttttagaatctctttcgaagttttcctaaagtgtatggtttgggagttgtttgtactgagccaggtttgaaaaggccattgctgagtttgaggtggtgccaccagttttgcaggtggcatcagaggctggcatgctggcaggaacatcccctcttagccccagtcttctcttttctataatgagacccaccccagcttgcctccctccctggcttctctgaccctcaaaggagatgccacgcaggacagactggagagagaagcctgggcaatactgcccgcctgtcatggcctggtggtggcccacacctatcttctcaccttggaggccacacccaactttccaaagaccctgagacaagtcaggaccctactactctcccctgctgctttcctgacagcttactcttcctccacctgctgagcctgtgccagactccattgctcaaatcgttagggttgcttctataaaaatgggtcagtagcccttcctgttctctccagcccagcatacaggaggatcaaaggaggtgacggagcatcgtggcacggcagtctcaatgggtcagaaacccaggccagctgggctctaagcctggcatcctgtcatgcttagtccttcagctgaagatcagaggaagcctctcccttgccctctccagctctaggggttttcaggaggcccaactgcaataatggagcactagtgcttttatgtgcaatggtgtcgtccatgcacgacagcagcaaacattctggggctgctttttattgttcccacggctgacagcgtggcagcggagactgtggaggcagtggagactgacttcttcctgctgacagctggatgtcacacatgaaggtctggcctagcgagtgatgggtctaggccctgaaactgatgtcctagcaataacctcttgatccctactcaccgagtgttgagcccaaggggggatttgtagaacaagcccccatgagaaacagctgttactctacacttttgattgcctatttctgatggcaagagatacatactctcttcaaagagcatgagatgcagccattctttcagcaaagcttcattgacacctgcacctgttaactgtgttcgacattgaagggagaaaggcaagatgtgcactctggactcaagaaactcttagttcagtggaggaaatgagcagataagtagatcattatgattgagagtaggagaagcttagagaaagcacagaatcccagatccagctggtgaaggagggaaggcttcaggcctttaagctcagcctgagaatattgtgaaatgcagaggatggggaaaagggaagagtaccgacttgaaaacggagagctgtcttggctgagggcagggtctgtgtggcaggatgggggagggagtcagaagggtcagatgaactggagtgtagacagcatcagatgcagcagtgcccaccgcccccccccccaccccccgccctgcccacagagcacctgctggtaaccctgggcctattgaaagcaggatgagatgataatttaagacactgaatgatttcttttccaacaaagctctatgttaagtgca

SEQ ID NO: 31730 - DNA, 4303 bp, Homo sapiens
acactccaccggaagctccgggcctggccgccggtaggcggtggcggaggcggcgccgagatggagtcatcagaacccactgtgaggaagtgacttctccttgaggtcacccagacactccaaacagagcagagcaaaagcgcctagaacttgaaattttggacctgtctccaacaccctggggatttccaccaggaagccttcagtcaccatccaggggatttttatcgccacaaagggtaattcctgctccatccctgctgtgactcagctgtgacgttgaaccacacaagccagagagaagaagataaagtcatcagagctcctactcaccagagagtgaggcccaggccaggactccacaaggctggtcccctgccctggagcaacttaaacaggccctctggccagcctggaaccctgagatggcctccagctcaggcagcagtcctcgcccggcccctgatgagaatgagtttccctttgggtgccctcccaccgtctgccaggacccaaaggagcccagggctctctgctgtgcaggctgtctctctgagaacccgaggaatggcgaggatcagatctgccccaaatgcagaggggaagacctccagtctataagcccaggaagccgtcttcgaactcaggagaaggctcaccccgaggtggctgaggctggaattgggtgcccctttgcaggtgtcggctgctccttcaagggaagcccacagtctgtgcaagagcatgaggtcacctcccagacctcccacctaaacctgctgttggggttcatgaaacagtggaaggcccggctgggctgtggcctggagtctgggcccatggccctggagcagaacctgtcagacctgcagctgcaggcagccgtggaagtggcgggggacctggaggtcgattgctaccgggcaccctgctccgagagccaggaggagctggccctgcagcacttcatgaaggagaagcttctggctgagctggaggggaagctgcgtgtgtttgagaacattgttgctgtcctcaacaaggaggtggaggcctcccacctggccctggccacctctatccaccagagccagctggaccgtgagcgcatcctgagcttggagcagagggtggtggagcttcagcagaccctggcccagaaagaccaggccctgggcaagctggagcagagcttgcgcctcatggaggaggcctccttcgatggcactttcctgtggaagatcaccaatgtcaccaggcggtgccatgagtcggcctgtggcaggaccgtcagcctcttctccccagccttctacactgccaagtatggctacaagttgtgcctgcggctgtacctgaatggagatggcactggaaagagaacccatctgtcgctcttcatcgtgatcatgagaggggagtatgatgcgctgctgccgtggcccttccggaacaaggtcaccttcatgctgctggaccagaacaaccgtgagcacgccattgacgccttccggcctgacctaagctcagcgtccttccagaggccccagagtgaaaccaacgtggccagtggatgcccactcttcttccccctcagcaaactgcagtcacccaagcacgcctacgtgaaggacgacacaatgttcctcaagtgcattgtggagaccagcacttagggtgggcggggctcctgagggagctccaactcagaagggagctagccagaggactgtgatgccctgcccttggcacccaagacctcagggcacaaagatgggtgaaggctggcatgatccaagcaagactgaggggtcgacttcgggctggccatctggttaggatggcaggacgtgggctgggcccacaaaggcaaagggtccagaaggagacaggcagagctgctcccctctgcacggaccatgcgacactgggaggccagtgagccactccggccccgaatgttgaggtggactctcaccaaatgagaagaaaatggaaccaggcttggaaccgtaggacccaagcagagaagctctcgggctaggaagatctctgcagggccgccagggagacctggacacaggcctgctctctttttctccagggtcagaaacaggaccgggtggaagggatggggtgccagtttgaatgcagtctgtccaggctcgtcattggaggtgaacaagcaaacccagacggctccactaggacttcaaattgggggttggatttgaagacttttaagtttccttccagcccagaaagtctctcattctaggcctcctggcccaggtgagtcctagagctacaggggttctggaaacattcaggagcttcctgtcctcccagctcctcactcaccttcagtaacccccactggactgacctggtccacagggcacctgccaccctgggcctggcagctcagcttccccaacacgcaggagcacacccagcccccacatcctgtgcctccatcagctaaacaccacgtcacttcatgcaggtgaaacccagtcactgtgagctcccaggtgcagccagaggcacctcaagaagaagaggggcataaactttcctcttcctgcctagaggccccacctttggtgctttccagaatcccgtaacacctgattaactgaggcatccacttctttcagcagactgatcaggacctccaagccactgagcaatgtataaccccaaagaaataatttttagaatctctttcgaagttttcctaaagtgtatggtttgggagttgtttgtactgagccaggtttgaaaaggccattgctgagtttgaggtggtgccaccagttttgcaggtggcatcagaggctggcatgctggcaggaacatcccctcttagccccagtcttctcttttctataatgagacccaccccagcttgcctccctccctggcttctctgaccctcaaaggagatgccacgcaggacagactggagagagaagcctgggcaatactgcccgcctgtcatggcctggtggtggcccacacctatcttctcaccttggaggccacacccaactttccaaagaccctgagacaagtcaggaccctactactctcccctgctgctttcctgacagcttactcttcctccacctgctgagcctgtgccagactccattgctcaaatcgttagggttgcttctataaaaatgggtcagtagcccttcctgttctctccagcccagcatacaggaggatcaaaggaggtgacggagcatcgtggcacggcagtctcaatgggtcagaaacccaggccagctgggctctaagcctggcatcctgtcatgcttagtccttcagctgaagatcagaggaagcctctcccttgccctctccagctctaggggttttcaggaggcccaactgcaataatggagcactagtgcttttatgtgcaatggtgtcgtccatgcacgacagcagcaaacattctggggctgctttttattgttcccacggctgacagcgtggcagcggagactgtggaggcagtggagactgacttcttcctgctgacagctggatgtcacacatgaaggtctggcctagcgagtgatgggtctaggccctgaaactgatgtcctagcaataacctcttgatccctactcaccgagtgttgagcccaaggggggatttgtagaacaagcccccatgagaaacagctgttactctacacttttgattgcctatttctgatggcaagagatacatactctcttcaaagagcatgagatgcagccattctttcagcaaagcttcattgacacctgcacctgttaactgtgttcgacattgaagggagaaaggcaagatgtgcactctggactcaagaaactcttagttcagtggaggaaatgagcagataagtagatcattatgattgagagtaggagaagcttagagaaagcacagaatcccagatccagctggtgaaggagggaaggcttcaggcctttaagctcagcctgagaatattgtgaaatgcagaggatggggaaaagggaagagtaccgacttgaaaacggagagctgtcttggctgagggcagggtctgtgtggcaggatgggggagggagtcagaagggtcagatgaactggagtgtagacagcatcagatgcagcagtgcccaccgcccccccccccaccccccgccctgcccacagagcacctgctggtaaccctgggcctattgaaagcaggatgagatgataatttaagacactgaatgatttcttttccaacaaagctctatgttaagtgca

SEQ ID NO: 31731 - DNA, 3715 bp, Homo sapiens
gatgattacggagctgtgtggactgtgccctgacaggagaaatagcagtgctgcccaggatcacagctcaccccgaggtggctgaggctggaattgggtgcccctttgcaggtgtcggctgctccttcaagggaagcccacagtctgtgcaagagcatgaggtcacctcccagacctcccacctaaacctgctgttggggttcatgaaacagtggaaggcccggctgggctgtggcctggagtctgggcccatggccctggagcagaacctgtcagacctgcagctgcaggcagccgtggaagtggcgggggacctggaggtcgattgctaccgggcaccctgctccgagagccaggaggagctggccctgcagcacttcatgaaggagaagcttctggctgagctggaggggaagctgcgtgtgtttgagaacattgttgctgtcctcaacaaggaggtggaggcctcccacctggccctggccacctctatccaccagagccagctggaccgtgagcgcatcctgagcttggagcagagggtggtggagcttcagcagaccctggcccagaaagaccaggccctgggcaagctggagcagagcttgcgcctcatggaggaggcctccttcgatggcactttcctgtggaagatcaccaatgtcaccaggcggtgccatgagtcggcctgtggcaggaccgtcagcctcttctccccagccttctacactgccaagtatggctacaagttgtgcctgcggctgtacctgaatggagatggcactggaaagagaacccatctgtcgctcttcatcgtgatcatgagaggggagtatgatgcgctgctgccgtggcccttccggaacaaggtcaccttcatgctgctggaccagaacaaccgtgagcacgccattgacgccttccggcctgacctaagctcagcgtccttccagaggccccagagtgaaaccaacgtggccagtggatgcccactcttcttccccctcagcaaactgcagtcacccaagcacgcctacgtgaaggacgacacaatgttcctcaagtgcattgtggagaccagcacttagggtgggcggggctcctgagggagctccaactcagaagggagctagccagaggactgtgatgccctgcccttggcacccaagacctcagggcacaaagatgggtgaaggctggcatgatccaagcaagactgaggggtcgacttcgggctggccatctggttaggatggcaggacgtgggctgggcccacaaaggcaaagggtccagaaggagacaggcagagctgctcccctctgcacggaccatgcgacactgggaggccagtgagccactccggccccgaatgttgaggtggactctcaccaaatgagaagaaaatggaaccaggcttggaaccgtaggacccaagcagagaagctctcgggctaggaagatctctgcagggccgccagggagacctggacacaggcctgctctctttttctccagggtcagaaacaggaccgggtggaagggatggggtgccagtttgaatgcagtctgtccaggctcgtcattggaggtgaacaagcaaacccagacggctccactaggacttcaaattgggggttggatttgaagacttttaagtttccttccagcccagaaagtctctcattctaggcctcctggcccaggtgagtcctagagctacaggggttctggaaacattcaggagcttcctgtcctcccagctcctcactcaccttcagtaacccccactggactgacctggtccacagggcacctgccaccctgggcctggcagctcagcttccccaacacgcaggagcacacccagcccccacatcctgtgcctccatcagctaaacaccacgtcacttcatgcaggtgaaacccagtcactgtgagctcccaggtgcagccagaggcacctcaagaagaagaggggcataaactttcctcttcctgcctagaggccccacctttggtgctttccagaatcccgtaacacctgattaactgaggcatccacttctttcagcagactgatcaggacctccaagccactgagcaatgtataaccccaaagaaataatttttagaatctctttcgaagttttcctaaagtgtatggtttgggagttgtttgtactgagccaggtttgaaaaggccattgctgagtttgaggtggtgccaccagttttgcaggtggcatcagaggctggcatgctggcaggaacatcccctcttagccccagtcttctcttttctataatgagacccaccccagcttgcctccctccctggcttctctgaccctcaaaggagatgccacgcaggacagactggagagagaagcctgggcaatactgcccgcctgtcatggcctggtggtggcccacacctatcttctcaccttggaggccacacccaactttccaaagaccctgagacaagtcaggaccctactactctcccctgctgctttcctgacagcttactcttcctccacctgctgagcctgtgccagactccattgctcaaatcgttagggttgcttctataaaaatgggtcagtagcccttcctgttctctccagcccagcatacaggaggatcaaaggaggtgacggagcatcgtggcacggcagtctcaatgggtcagaaacccaggccagctgggctctaagcctggcatcctgtcatgcttagtccttcagctgaagatcagaggaagcctctcccttgccctctccagctctaggggttttcaggaggcccaactgcaataatggagcactagtgcttttatgtgcaatggtgtcgtccatgcacgacagcagcaaacattctggggctgctttttattgttcccacggctgacagcgtggcagcggagactgtggaggcagtggagactgacttcttcctgctgacagctggatgtcacacatgaaggtctggcctagcgagtgatgggtctaggccctgaaactgatgtcctagcaataacctcttgatccctactcaccgagtgttgagcccaaggggggatttgtagaacaagcccccatgagaaacagctgttactctacacttttgattgcctatttctgatggcaagagatacatactctcttcaaagagcatgagatgcagccattctttcagcaaagcttcattgacacctgcacctgttaactgtgttcgacattgaagggagaaaggcaagatgtgcactctggactcaagaaactcttagttcagtggaggaaatgagcagataagtagatcattatgattgagagtaggagaagcttagagaaagcacagaatcccagatccagctggtgaaggagggaaggcttcaggcctttaagctcagcctgagaatattgtgaaatgcagaggatggggaaaagggaagagtaccgacttgaaaacggagagctgtcttggctgagggcagggtctgtgtggcaggatgggggagggagtcagaagggtcagatgaactggagtgtagacagcatcagatgcagcagtgcccaccgcccccccccccaccccccgccctgcccacagagcacctgctggtaaccctgggcctattgaaagcaggatgagatgataatttaagacactgaatgatttcttttccaacaaagctctatgttaagtgca

SEQ ID NO: 31732 - DNA, 4279 bp, Homo sapiens
gtccgttgctaaggccgcgcagccctagtgaccgaacgccctgcggcggccgcgcaggcgctgtggtgggctccggtgcactgtgggatggaaaccggagcggcgcgtcctggcaggaccgggcggcggcggcggcggggccggcggcggccagggacccgggcttaggctcggccaggccggctgaggggcgcgggcggccagcgggcggcggacgccgtcatgaacgcggcggtggtgaggcggacgcaggaggcgctggggaaagtgattcggaggccgccgctgaccgagaagctgctgagcaagcccccgttccgctacctgcacgacatcatcacggaggtgattagaatgactggtttcatgaagggcctctacacagacgccgagatgaagtctgataatgtgaaggataaagatgcaaaaattagcttcctacaaaaggccatagacgtggttgtaatggtgtcgggagagccactgttggccaaaccagcccgaatcgtggcggggcatgagcctgaaagaacaaacgagctgctccagataattggaaaatgctgtctcaacaagctctctagtgacgatgcggtgcggagggttttagctggagagaagggagaagtgaaaggccgggcctcactgacctcaagatctcaggaattggataataagaatgtgcgagaagaagagtccagagttcacaaaaatacagaggatagaggagacgctgaaataaaagagagaagtacaagcagagatcgaaaacagaaggaagaattgaaagaagaccgcaagccaagagaaaaggacaaggacaaggagaaggccaaggagaatggcggaaacagacacagagaaggggagagagagagagccaaagcccgggccaggccagacaacgagcgacagaaagacagaggcaacagggagcgggacagagactccgagcgcaagaaggagacagagagaaagagtgagggggggaaagagaaggagagactgagagacagggaccgagagcgcgaccgggacaaagggaaggacagggacagacggagagtgaaaaacggggagcactcctgggacctggacagggagaagaacagagagcatgacaaacctgagaaaaagtcagcaagctcaggggagatgtctaaaaagttatcagatggaacttttaaagactccaaggctgaaacagagactgagatttccactagagcttccaagtcattgacaacaaaaacatcaaaacggcgatccaaaaattcagtggaaggaaggaaggaggataatatttcagctaaaagtttagactccatagtgtctggaataaataatgagccaaatcaggaaacgacaacatcagaaataggaacaaaagaagctaatattaactcaactagtatttcagatgataattcagctagtctgcggtgtgagaatattcagcccaaccccacagagaagcagaaaggtgactccaccagtgatgcagaaggagatgctggacctgctggccaagataagtctgaggtgccagagactccagaaattcctaatgagctttcatccaacatcagaagaattcctcggcctgggagtgcaagaccagcccctccccgggtcaaacggcaagacagcatggaggcgctacaaatggataggtcagggagtggtaaaaccgtttcaaatgtgattacagagtcacacaattctgacaatgaagaggatgatcaatttgtggtggaagctgcccctcagctctctgaaatgtcagaaattgaaatggtaacagcagtggaactagaagaagaggagaagcatggtggacttgtgaaaaaaattttggagacgaagaaagattatgagaaattgcagcagtcacccaaacctggggagaaggagcgatctctctttgagtcggcatggaagaaggagaaggacatcgtttccaaggagatagagaagctccgcacgtccatccagaccctgtgcaagagcgcacttcccctggggaagatcatggactacatccaggaagacgtggatgccatgcagaatgagctgcagatgtggcacagcgagaacaggcagcacgccgaggccctgcagcaggagcagaggatcacagactgtgccgtggagcccttaaaggctgagctcgcggagctggagcagctgatcaaagaccagcaagacaagatctgtgctgtgaaggccaacatcctcaagaatgaagaaaaaatccagaaaatggtatatagtatcaatttgacttcgagaaggtgaacactcaaaagtttcagagatgaaaagtcacctcagtttaaaagcaaaaaggaagatagaaaatcattactcttttaagttccagtttgctaagaaaatgaacagtttacaatgttattatccagctaattttcagagctttaaaactgtaagcatgttaagtgtattaaaaaaaccatgttttcttacctccttccagatggaatactggctagttataaatagcgcttccaaacacctctgtgaaaagtttttttgaaagcctgttctttgtgtttctgctgtaacctgtttagttctgtaccagaactctctagcaggtaagtggtgtgggcataccaagggaacagtagtcctttattttggtttagtggaaagactttcagaggtcagtgccgaatgaaggatgactgtgtactttttgataggcacttgataagtagaatgaggcctgaaaatgaatacattatatttttagttaatttccaatggaaagggctaacctcagcctgtctccatatcaggtacctatcaactggattgttttcatttttgttttttgacctctttgtaattgcatgtacttctctatgtaattttcctcttgatctctactatcgtttgcttgtgtttctagtccttaaagttcataaatttaaaaaggagatttcaggatggcctttatggacgttgtctggacatacatcctcactttcttccgcagtttaccctggttttcctcagacagaggctagcgcagccccccggagtccttgttctccttaagagggtctcgctctgcaaagcattggcgccatggcttttcctttgcatgggtgtgcataccgagagacaggcagcttaggaaaaacaacataaggaagacttaaaaggatgcactgatttacgacgttttttgatgttagccatttttttggaaattgttttttaaagcaaaagttttttaaaaacatggtttatagtttttcacttacatatactattgtaaatacttagcagagtcttaagttactgtataaaacatttcattgtgtttgaagacatacttatgggtcttgaggtctgggtcctaatacttttaaatagtgtatttattatgtaaactgaggagtgccatttaaagtgtgaggattgcctgaaaaggttttgtttctttcttttttttttttttttgagatggagtcttactctgtcgcccaggctggagtgcagtggcgcaatctcggctcactgcaaccaccgcctcccgagttcaagtgattctcctgcctcagcctcctgagtaactgggactacaggcgcacgccaccatgcccagctaatttttgtattttcagtagagatggggtttcaccgtgttgaccaggatggtctccacctcctgacctcgtgatccgcctgcctcggcctcccaaagtgctgggattacaggcatgagccactgcacccggccaggttttgtttctttaaggattagcacaaatggcaccgttgggtttttcttcatacaatttccaaaataaattctgtactcaggttgttatatgattttctgagctgaataagttcaggagcagattattaagatctgccattctgaaacgctggtctttttctccttcctatagtgcaccataaaattctgtttgatcagattatattacatacattttgggggagtggagggacatgagttaagtagcccttcatgtatttataatctcttttctactgaatcaaatgacttagccatgaccctgaatggaccttgttttacttcaagttgagatgtctgccttttatgaatttgtatatgtgaatagagtttgggggttgccaaaaattgcatacattgtatgtaagtaaaattttttatgaagtagtctgtcaaattgtatcataaagtttatttttcttttatacgtaaatcattaaaaataatcacatattttttccataa

SEQ ID NO: 31733 - DNA, 4003 bp, Homo sapiens
gtccgttgctaaggccgcgcagccctagtgaccgaacgccctgcggcggccgcgcaggcgctgtggtgggctccggtgcactgtgggatggaaaccggagcggcgcgtcctggcaggaccgggcggcggcggcggcggggccggcggcggccagggacccgggcttaggctcggccaggccggctgaggggcgcgggcggccagcgggcggcggacgccgtcatgaacgcggcggtggtgaggcggacgcaggaggcgctggggaaagtgattcggaggccgccgctgaccgagaagctgctgagcaagcccccgttccgctacctgcacgacatcatcacggaggtgattagaatgactggtttcatgaagggcctctacacagacgccgagatgaagtctgataatgtgaaggataaagatgcaaaaattagcttcctacaaaaggccatagacgtggttgtaatggtgtcgggagagccactgttggccaaaccagcccgaatcgtggcggggcatgagcctgaaagaacaaacgagctgctccagataattggaaaatgctgtctcaacaagctctctagtgacgatgcggtgcggagggttttagctggagagaagggagaagtgaaaggccgggcctcactgacctcaagatctcaggaattggataataagaatgtgcgagaagaagagtccagagttcacaaaaatacagaggatagaggagacgctgaaataaaagagagaagtacaagcagagatcgaaaacagaaggaagaattgaaagaagaccgcaagccaagagaaaaggacaaggacaaggagaaggccaaggagaatggcggaaacagacacagagaaggggagagagagagagccaaagcccgggccaggccagacaacgagcgacagaaagacagaggcaacagggagcgggacagagactccgagcgcaagaaggagacagagagaaagagtgagggggggaaagagaaggagagactgagagacagggaccgagagcgcgaccgggacaaagggaaggacagggacagacggagagtgaaaaacggggagcactcctgggacctggacagggagaagaacagagagcatgacaaacctgagaaaaagtcagcaagctcaggggagatgtctaaaaagttatcagatggaacttttaaagactccaaggctgaaacagagactgagatttccactagagcttccaagtcattgacaacaaaaacatcaaaacggcgatccaaaaattcagtggaaggtgactccaccagtgatgcagaaggagatgctggacctgctggccaagataagtctgaggtgccagagactccagaaattcctaatgagctttcatccaacatcagaagaattcctcggcctgggagtgcaagaccagcccctccccgggtcaaacggcaagacagcatggaggcgctacaaatggataggtcagggagtggtaaaaccgtttcaaatgtgattacagagtcacacaattctgacaatgaagaggatgatcaatttgtggtggaagctgcccctcagctctctgaaatgtcagaaattgaaatggtaacagcagtggaactagaagaagaggagaagcatggtggacttgtgaaaaaaattttggagacgaagaaagattatgagaaattgcagcagtcacccaaacctggggagaaggagcgatctctctttgagtcggcatggaagaaggagaaggacatcgtttccaaggagatagagaagctccgcacgtccatccagaccctgtgcaagagcgcacttcccctggggaagatcatggactacatccaggaagacgtggatgccatgcagaatgagctgcagatgtggcacagcgagaacaggcagcacgccgaggccctgcagcaggagcagaggatcacagactgtgccgtggagcccttaaaggctgagctcgcggagctggagcagctgatcaaagaccagcaagacaagatctgtgctgtgaaggccaacatcctcaagaatgaagaaaaaatccagaaaatggtatatagtatcaatttgacttcgagaaggtgaacactcaaaagtttcagagatgaaaagtcacctcagtttaaaagcaaaaaggaagatagaaaatcattactcttttaagttccagtttgctaagaaaatgaacagtttacaatgttattatccagctaattttcagagctttaaaactgtaagcatgttaagtgtattaaaaaaaccatgttttcttacctccttccagatggaatactggctagttataaatagcgcttccaaacacctctgtgaaaagtttttttgaaagcctgttctttgtgtttctgctgtaacctgtttagttctgtaccagaactctctagcaggtaagtggtgtgggcataccaagggaacagtagtcctttattttggtttagtggaaagactttcagaggtcagtgccgaatgaaggatgactgtgtactttttgataggcacttgataagtagaatgaggcctgaaaatgaatacattatatttttagttaatttccaatggaaagggctaacctcagcctgtctccatatcaggtacctatcaactggattgttttcatttttgttttttgacctctttgtaattgcatgtacttctctatgtaattttcctcttgatctctactatcgtttgcttgtgtttctagtccttaaagttcataaatttaaaaaggagatttcaggatggcctttatggacgttgtctggacatacatcctcactttcttccgcagtttaccctggttttcctcagacagaggctagcgcagccccccggagtccttgttctccttaagagggtctcgctctgcaaagcattggcgccatggcttttcctttgcatgggtgtgcataccgagagacaggcagcttaggaaaaacaacataaggaagacttaaaaggatgcactgatttacgacgttttttgatgttagccatttttttggaaattgttttttaaagcaaaagttttttaaaaacatggtttatagtttttcacttacatatactattgtaaatacttagcagagtcttaagttactgtataaaacatttcattgtgtttgaagacatacttatgggtcttgaggtctgggtcctaatacttttaaatagtgtatttattatgtaaactgaggagtgccatttaaagtgtgaggattgcctgaaaaggttttgtttctttcttttttttttttttttgagatggagtcttactctgtcgcccaggctggagtgcagtggcgcaatctcggctcactgcaaccaccgcctcccgagttcaagtgattctcctgcctcagcctcctgagtaactgggactacaggcgcacgccaccatgcccagctaatttttgtattttcagtagagatggggtttcaccgtgttgaccaggatggtctccacctcctgacctcgtgatccgcctgcctcggcctcccaaagtgctgggattacaggcatgagccactgcacccggccaggttttgtttctttaaggattagcacaaatggcaccgttgggtttttcttcatacaatttccaaaataaattctgtactcaggttgttatatgattttctgagctgaataagttcaggagcagattattaagatctgccattctgaaacgctggtctttttctccttcctatagtgcaccataaaattctgtttgatcagattatattacatacattttgggggagtggagggacatgagttaagtagcccttcatgtatttataatctcttttctactgaatcaaatgacttagccatgaccctgaatggaccttgttttacttcaagttgagatgtctgccttttatgaatttgtatatgtgaatagagtttgggggttgccaaaaattgcatacattgtatgtaagtaaaattttttatgaagta

SEQ ID NO: 31734 - DNA, 4172 bp, Homo sapiens
cgcgtcctggcaggaccgggcggcggcggcggcggggccggcggcggccagggacccgggcttaggctcggccaggccggctgaggggcgcgggcggccagcgggcggcggacgccgtcatgaacgcggcggtggtgaggcggacgcaggaggcgctggggaaagtgattcggaggccgccgctgaccgagaagctgctgagcaagcccccgttccgctacctgcacgacatcatcacggaggtgattagaatgactggtttcatgaagggcctctacacagacgccgagatgaagtctgataatgtgaaggataaagatgcaaaaattagcttcctacaaaaggccatagacgtggttgtaatggtgtcgggagagccactgttggccaaaccagcccgaatcgtggcggggcatgagcctgaaagaacaaacgagctgctccagataattggaaaatgctgtctcaacaagctctctagtgacgatgcggtgcggagggttttagctggagagaagggagaagtgaaaggccgggcctcactgacctcaagatctcaggaattggataataagaatgtgcgagaagaagagtccagagttcacaaaaatacagaggatagaggagacgctgaaataaaagagagaagtacaagcagagatcgaaaacagaaggaagaattgaaagaagaccgcaagccaagagaaaaggacaaggacaaggagaaggccaaggagaatggcggaaacagacacagagaaggggagagagagagagccaaagcccgggccaggccagacaacgagcgacagaaagacagaggcaacagggagcgggacagagactccgagcgcaagaaggagacagagagaaagagtgagggggggaaagagaaggagagactgagagacagggaccgagagcgcgaccgggacaaagggaaggacagggacagacggagagtgaaaaacggggagcactcctgggacctggacagggagaagaacagagagcatgacaaacctgagaaaaagtcagcaagctcaggggagatgtctaaaaagttatcagatggaacttttaaagactccaaggctgaaacagagactgagatttccactagagcttccaagtcattgacaacaaaaacatcaaaacggcgatccaaaaattcagtggaaggaaggaaggaggataatatttcagctaaaagtttagactccatagtgtctggaataaataatgagccaaatcaggaaacgacaacatcagaaataggaacaaaagaagctaatattaactcaactagtatttcagatgataattcagctagtctgcggtgtgagaatattcagcccaaccccacagagaagcagaaaggtaagaatgggtctgaacgtgaaggagatgctggacctgctggccaagataagtctgaggtgccagagactccagaaattcctaatgagctttcatccaacatcagaagaattcctcggcctgggagtgcaagaccagcccctccccgggtcaaacggcaagacagcatggaggcgctacaaatggataggtcagggagtggtaaaaccgtttcaaatgtgattacagagtcacacaattctgacaatgaagaggatgatcaatttgtggtggaagctgcccctcagctctctgaaatgtcagaaattgaaatggtaacagcagtggaactagaagaagaggagaagcatggtggacttgtgaaaaaaattttggagacgaagaaagattatgagaaattgcagcagtcacccaaacctggggagaaggagcgatctctctttgagtcggcatggaagaaggagaaggacatcgtttccaaggagatagagaagctccgcacgtccatccagaccctgtgcaagagcgcacttcccctggggaagatcatggactacatccaggaagacgtggatgccatgcagaatgagctgcagatgtggcacagcgagaacaggcagcacgccgaggccctgcagcaggagcagaggatcacagactgtgccgtggagcccttaaaggctgagctcgcggagctggagcagctgatcaaagaccagcaagacaagatctgtgctgtgaaggccaacatcctcaagaatgaagaaaaaatccagaaaatggtatatagtatcaatttgacttcgagaaggtgaacactcaaaagtttcagagatgaaaagtcacctcagtttaaaagcaaaaaggaagatagaaaatcattactcttttaagttccagtttgctaagaaaatgaacagtttacaatgttattatccagctaattttcagagctttaaaactgtaagcatgttaagtgtattaaaaaaaccatgttttcttacctccttccagatggaatactggctagttataaatagcgcttccaaacacctctgtgaaaagtttttttgaaagcctgttctttgtgtttctgctgtaacctgtttagttctgtaccagaactctctagcaggtaagtggtgtgggcataccaagggaacagtagtcctttattttggtttagtggaaagactttcagaggtcagtgccgaatgaaggatgactgtgtactttttgataggcacttgataagtagaatgaggcctgaaaatgaatacattatatttttagttaatttccaatggaaagggctaacctcagcctgtctccatatcaggtacctatcaactggattgttttcatttttgttttttgacctctttgtaattgcatgtacttctctatgtaattttcctcttgatctctactatcgtttgcttgtgtttctagtccttaaagttcataaatttaaaaaggagatttcaggatggcctttatggacgttgtctggacatacatcctcactttcttccgcagtttaccctggttttcctcagacagaggctagcgcagccccccggagtccttgttctccttaagagggtctcgctctgcaaagcattggcgccatggcttttcctttgcatgggtgtgcataccgagagacaggcagcttaggaaaaacaacataaggaagacttaaaaggatgcactgatttacgacgttttttgatgttagccatttttttggaaattgttttttaaagcaaaagttttttaaaaacatggtttatagtttttcacttacatatactattgtaaatacttagcagagtcttaagttactgtataaaacatttcattgtgtttgaagacatacttatgggtcttgaggtctgggtcctaatacttttaaatagtgtatttattatgtaaactgaggagtgccatttaaagtgtgaggattgcctgaaaaggttttgtttctttcttttttttttttttttgagatggagtcttactctgtcgcccaggctggagtgcagtggcgcaatctcggctcactgcaaccaccgcctcccgagttcaagtgattctcctgcctcagcctcctgagtaactgggactacaggcgcacgccaccatgcccagctaatttttgtattttcagtagagatggggtttcaccgtgttgaccaggatggtctccacctcctgacctcgtgatccgcctgcctcggcctcccaaagtgctgggattacaggcatgagccactgcacccggccaggttttgtttctttaaggattagcacaaatggcaccgttgggtttttcttcatacaatttccaaaataaattctgtactcaggttgttatatgattttctgagctgaataagttcaggagcagattattaagatctgccattctgaaacgctggtctttttctccttcctatagtgcaccataaaattctgtttgatcagattatattacatacattttgggggagtggagggacatgagttaagtagcccttcatgtatttataatctcttttctactgaatcaaatgacttagccatgaccctgaatggaccttgttttacttcaagttgagatgtctgccttttatgaatttgtatatgtgaatagagtttgggggttgccaaaaattgcatacattgtatgtaagtaaaattttttatgaagtagtctgtcaaattgtatcataaagtttatttttcttttatacgtaaatcattaaaaataatcacatattttttcc

SEQ ID NO: 31735 - DNA, 3974 bp, Homo sapiens
cgcgtcctggcaggaccgggcggcggcggcggcggggccggcggcggccagggacccgggcttaggctcggccaggccggctgaggggcgcgggcggccagcgggcggcggacgccgtcatgaacgcggcggtggtgaggcggacgcaggaggcgctggggaaagtgattcggaggccgccgctgaccgagaagctgctgagcaagcccccgttccgctacctgcacgacatcatcacggaggtgattagaatgactggtttcatgaagggcctctacacagacgccgagatgaagtctgataatgtgaaggataaagatgcaaaaattagcttcctacaaaaggccatagacgtggttgtaatggtgtcgggagagccactgttggccaaaccagcccgaatcgtggcggggcatgagcctgaaagaacaaacgagctgctccagataattggaaaatgctgtctcaacaagctctctagtgacgatgcggtgcggagggttttagctggagagaagggagaagtgaaaggccgggcctcactgacctcaagatctcaggaattggataataagaatgtgcgagaagaagagtccagagttcacaaaaatacagaggatagaggagacgctgaaataaaagagagaagtacaagcagagatcgaaaacagaaggaagaattgaaagaagaccgcaagccaagagaaaaggacaaggacaaggagaaggccaaggagaatggcggaaacagacacagagaaggggagagagagagagccaaagcccgggccaggccagacaacgagcgacagaaagacagaggcaacagggagcgggacagagactccgagcgcaagaaggagacagagagaaagagtgagggggggaaagagaaggagagactgagagacagggaccgagagcgcgaccgggacaaagggaaggacagggacagacggagagtgaaaaacggggagcactcctgggacctggacagggagaagaacagagagcatgacaaacctgagaaaaagtcagcaagctcaggggagatgtctaaaaagttatcagatggaacttttaaagactccaaggctgaaacagagactgagatttccactagagcttccaagtcattgacaacaaaaacatcaaaacggcgatccaaaaattcagtggaaggtactgcaaaacttattttagaaggagatgctggacctgctggccaagataagtctgaggtgccagagactccagaaattcctaatgagctttcatccaacatcagaagaattcctcggcctgggagtgcaagaccagcccctccccgggtcaaacggcaagacagcatggaggcgctacaaatggataggtcagggagtggtaaaaccgtttcaaatgtgattacagagtcacacaattctgacaatgaagaggatgatcaatttgtggtggaagctgcccctcagctctctgaaatgtcagaaattgaaatggtaacagcagtggaactagaagaagaggagaagcatggtggacttgtgaaaaaaattttggagacgaagaaagattatgagaaattgcagcagtcacccaaacctggggagaaggagcgatctctctttgagtcggcatggaagaaggagaaggacatcgtttccaaggagatagagaagctccgcacgtccatccagaccctgtgcaagagcgcacttcccctggggaagatcatggactacatccaggaagacgtggatgccatgcagaatgagctgcagatgtggcacagcgagaacaggcagcacgccgaggccctgcagcaggagcagaggatcacagactgtgccgtggagcccttaaaggctgagctcgcggagctggagcagctgatcaaagaccagcaagacaagatctgtgctgtgaaggccaacatcctcaagaatgaagaaaaaatccagaaaatggtatatagtatcaatttgacttcgagaaggtgaacactcaaaagtttcagagatgaaaagtcacctcagtttaaaagcaaaaaggaagatagaaaatcattactcttttaagttccagtttgctaagaaaatgaacagtttacaatgttattatccagctaattttcagagctttaaaactgtaagcatgttaagtgtattaaaaaaaccatgttttcttacctccttccagatggaatactggctagttataaatagcgcttccaaacacctctgtgaaaagtttttttgaaagcctgttctttgtgtttctgctgtaacctgtttagttctgtaccagaactctctagcaggtaagtggtgtgggcataccaagggaacagtagtcctttattttggtttagtggaaagactttcagaggtcagtgccgaatgaaggatgactgtgtactttttgataggcacttgataagtagaatgaggcctgaaaatgaatacattatatttttagttaatttccaatggaaagggctaacctcagcctgtctccatatcaggtacctatcaactggattgttttcatttttgttttttgacctctttgtaattgcatgtacttctctatgtaattttcctcttgatctctactatcgtttgcttgtgtttctagtccttaaagttcataaatttaaaaaggagatttcaggatggcctttatggacgttgtctggacatacatcctcactttcttccgcagtttaccctggttttcctcagacagaggctagcgcagccccccggagtccttgttctccttaagagggtctcgctctgcaaagcattggcgccatggcttttcctttgcatgggtgtgcataccgagagacaggcagcttaggaaaaacaacataaggaagacttaaaaggatgcactgatttacgacgttttttgatgttagccatttttttggaaattgttttttaaagcaaaagttttttaaaaacatggtttatagtttttcacttacatatactattgtaaatacttagcagagtcttaagttactgtataaaacatttcattgtgtttgaagacatacttatgggtcttgaggtctgggtcctaatacttttaaatagtgtatttattatgtaaactgaggagtgccatttaaagtgtgaggattgcctgaaaaggttttgtttctttcttttttttttttttttgagatggagtcttactctgtcgcccaggctggagtgcagtggcgcaatctcggctcactgcaaccaccgcctcccgagttcaagtgattctcctgcctcagcctcctgagtaactgggactacaggcgcacgccaccatgcccagctaatttttgtattttcagtagagatggggtttcaccgtgttgaccaggatggtctccacctcctgacctcgtgatccgcctgcctcggcctcccaaagtgctgggattacaggcatgagccactgcacccggccaggttttgtttctttaaggattagcacaaatggcaccgttgggtttttcttcatacaatttccaaaataaattctgtactcaggttgttatatgattttctgagctgaataagttcaggagcagattattaagatctgccattctgaaacgctggtctttttctccttcctatagtgcaccataaaattctgtttgatcagattatattacatacattttgggggagtggagggacatgagttaagtagcccttcatgtatttataatctcttttctactgaatcaaatgacttagccatgaccctgaatggaccttgttttacttcaagttgagatgtctgccttttatgaatttgtatatgtgaatagagtttgggggttgccaaaaattgcatacattgtatgtaagtaaaattttttatgaagtagtctgtcaaattgtatcataaagtttatttttcttttatacgtaaatcattaaaaataatcacatattttttcc

SEQ ID NO: 31736 - DNA, 3972 bp, Homo sapiens
gcagcagccgcgcctgcagaccggcctcgcggagcccgcgcgccgagccccacaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttagaatattctcttattatttatatttttatatttcttgaaagatggtaagtttcttgaagtttttggggcgtttctcttttactggtgcttagcgcagtgtctcgggcactctaaatattgagtgttatggaggacacagaggtagcagaatcccagttgaaaatgttttgatattttattgtttggcctattgattctagacctggccttaagtctgcaaaagccatctttataaggtaggctgttccagttaagtagtgggtgatgtagttacaaagataatatgctcagtttggacctttttttcagttaaatgctaaatatatgaaaattactatacctctaagtattttcatgaaattcaccagcagtttgcaagcacagttttgcaaggctgcataagaactggtgaatggggtaagcattttcattcttcctgctgaagtaaagcagaaagtactgcatagtatatgagatatagccagctagctaaagttcagattttgttaggttcaaccctatgaaaaaaactattttcataggtcaaaaatggtaaaaaattagcagtttcataagattcaaccaaataaatatatatatacacacacacatacatatacacctatatatgtgtgtatacaaacagttcgaatgtattttggtgacagtaataaatcaatgtgaggatggatagaatttagtatatgatagagaaaatgtcataaatggataaaaggaatttacaacttgaggagaaaacctttacaatttcctatgggtgtcagaagtactctcagcgaaaactgatggctaaaacagtatctactattctctgataactttttttttgagacagagtttcattgtcacccaggctggagtacagtggcatgatctcagctcactgcaaactctgcctcccgaattcaagtgattctcctgcctcagcctcctgagtagctgggattacaggcgcccgtcaccacacccaggtaatttttgtatttttagtagagacggagttttgccatgttggccaagctgatctcaaactcctgacctcaagtgatctgcccgcctcggcctcccaaagtgctgagattacaggcatgacccaccgcgtcaagcctctgacaactattgaatttgtaagctgctatgcaaatgggcatttatataaacttgtgatgtttcttgtcagaattctgagtactctgtgaagaacagaaatgatcatattcttatgcatctatctgtatgggtctgaaggtgtatatacaaactgagatgagtccttatgactcttgataagcctgagtttaacaacaacaaaaatgccaagttgtcctgagcccttctgcgttgttatgccacttccctactgctcatatgcacgctggctcccctgggcacgcaaggatgagtatgggccatgggcccctgtagagctgcttacctggtgatgaccatgcaccttacaatttctgaacagttaaccctatagaagcatgctttatatgagtgtcttctgggaagaggaaccttcttaatctcttctgtgggattttcaaaatgctaaagactcacactgcagcaatcatcccagatgattaaattcaaagaaataggttcacaacaggaatatactgaagaactagagtgtcactgctggtgaactgtggcacggttgctcaacacatcacctcggacaaattcaggaagcatttctttagcccacaagtccagacccaggtgctctgtatgtttgtttttaatattcatcatatccaagttcactctgtcttcctgagcagtggaagatcatattgctgtaacttcttttaagtagttgatgtggaaaacattttaaagtgaatttgtcaaaatgctggttttgtgttttatccaacttttgtgcatatatataaagtatgtcatggcatggtttgcttaggagttcagagttccttcatcatcgaaatagtgattaagtgatcccagaacaaggaatactagagtaaaaagcacctctttttcacaaaa

SEQ ID NO: 31737 - DNA, 3972 bp, Homo sapiens
agacgcacgtgagggaaatcagatgactggacttgtagatactaacggttctgaagcggaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttagaatattctcttattatttatatttttatatttcttgaaagatggtaagtttcttgaagtttttggggcgtttctcttttactggtgcttagcgcagtgtctcgggcactctaaatattgagtgttatggaggacacagaggtagcagaatcccagttgaaaatgttttgatattttattgtttggcctattgattctagacctggccttaagtctgcaaaagccatctttataaggtaggctgttccagttaagtagtgggtgatgtagttacaaagataatatgctcagtttggacctttttttcagttaaatgctaaatatatgaaaattactatacctctaagtattttcatgaaattcaccagcagtttgcaagcacagttttgcaaggctgcataagaactggtgaatggggtaagcattttcattcttcctgctgaagtaaagcagaaagtactgcatagtatatgagatatagccagctagctaaagttcagattttgttaggttcaaccctatgaaaaaaactattttcataggtcaaaaatggtaaaaaattagcagtttcataagattcaaccaaataaatatatatatacacacacacatacatatacacctatatatgtgtgtatacaaacagttcgaatgtattttggtgacagtaataaatcaatgtgaggatggatagaatttagtatatgatagagaaaatgtcataaatggataaaaggaatttacaacttgaggagaaaacctttacaatttcctatgggtgtcagaagtactctcagcgaaaactgatggctaaaacagtatctactattctctgataactttttttttgagacagagtttcattgtcacccaggctggagtacagtggcatgatctcagctcactgcaaactctgcctcccgaattcaagtgattctcctgcctcagcctcctgagtagctgggattacaggcgcccgtcaccacacccaggtaatttttgtatttttagtagagacggagttttgccatgttggccaagctgatctcaaactcctgacctcaagtgatctgcccgcctcggcctcccaaagtgctgagattacaggcatgacccaccgcgtcaagcctctgacaactattgaatttgtaagctgctatgcaaatgggcatttatataaacttgtgatgtttcttgtcagaattctgagtactctgtgaagaacagaaatgatcatattcttatgcatctatctgtatgggtctgaaggtgtatatacaaactgagatgagtccttatgactcttgataagcctgagtttaacaacaacaaaaatgccaagttgtcctgagcccttctgcgttgttatgccacttccctactgctcatatgcacgctggctcccctgggcacgcaaggatgagtatgggccatgggcccctgtagagctgcttacctggtgatgaccatgcaccttacaatttctgaacagttaaccctatagaagcatgctttatatgagtgtcttctgggaagaggaaccttcttaatctcttctgtgggattttcaaaatgctaaagactcacactgcagcaatcatcccagatgattaaattcaaagaaataggttcacaacaggaatatactgaagaactagagtgtcactgctggtgaactgtggcacggttgctcaacacatcacctcggacaaattcaggaagcatttctttagcccacaagtccagacccaggtgctctgtatgtttgtttttaatattcatcatatccaagttcactctgtcttcctgagcagtggaagatcatattgctgtaacttcttttaagtagttgatgtggaaaacattttaaagtgaatttgtcaaaatgctggttttgtgttttatccaacttttgtgcatatatataaagtatgtcatggcatggtttgcttaggagttcagagttccttcatcatcgaaatagtgattaagtgatcccagaacaaggaatactagagtaaaaagcacctctttttc

SEQ ID NO: 31738 - DNA, 1827 bp, Homo sapiens
agtgcagggatgtgcagatgagtgggctgtggggtgtcctgctcacggtttcatggatgaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaa

SEQ ID NO: 31739 - DNA, 1622 bp, Homo sapiens
gcagccaggagcagcagccgcgcctgcagaccggcctcgcggagcccgcgcgccgagccccacaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttag

SEQ ID NO: 31740 - DNA, 2558 bp, Homo sapiens
gcagtggcgtccgcagctggggcttggcctgcgggcggccagcgaaggtggcgaaggctcccactggatccagagtttgccgtccaagcagcctcgtctcggcgcgcagtgtctgtgtccgtcctctaccagcgccttggctgagcggagtcgtgcggttggtgggggagccctgccctcctggttcggcctccccgcgcactagaacgatcatgaacttctgaagggacccagctttctttgtgtgctccaagtgatttgcacaaataataatatatatatttattgaaggagagaatcagagcaagtgataatcaagttactatgagtctgctaaactgtgaaaacagctgtggatccagccagtctgaaagtgactgctgtgtggccatggccagctcctgtagcgctgtaacaaaagatgatagtgtgggtggaactgccagcacggggaacctctccagctcatttatggaggagatccagggatatgatgtagagtttgacccacccctggaaagcaagtatgaatgccccatctgcttgatggcattacgagaagcagtgcaaacgccatgcggccataggttctgcaaagcctgcatcataaaatcaataagggatgcaggtcacaaatgtccagttgacaatgaaatactgctggaaaatcaactatttccagacaattttgcaaaacgtgagattctttctctgatggtgaaatgtccaaatgaaggttgtttgcacaagatggaactgagacatcttgaggatcatcaagcacattgtgagtttgctcttatggattgtccccaatgccagcgtcccttccaaaaattccatattaatattcacattctgaaggattgtccaaggagacaggtttcttgtgacaactgtgctgcatcaatggcatttgaagataaagagatccatgaccagaactgtcctttggcaaatgtcatctgtgaatactgcaatactatactcatcagagaacagatgcctaatcattatgatctagactgccctacagccccaattccatgcacattcagtacttttggttgccatgaaaagatgcagaggaatcacttggcacgccacctacaagagaacacccagtcacacatgagaatgttggcccaggctgttcatagtttgagcgttatacccgactctgggtatatctcagaggtccggaatttccaggaaactattcaccagttagagggtcgccttgtaagacaagaccatcaaatccgggagctgactgctaaaatggaaactcagagtatgtatgtaagtgagctcaaacgaaccattcgaacccttgaggacaaagttgctgaaatcgaagcacagcagtgcaatggaatttatatttggaagattggcaactttggaatgcatttgaaatgtcaagaagaggagaaacctgttgtgattcatagccctggattctacactggcaaacccgggtacaaactgtgcatgcgcttgcaccttcagttaccgactgctcagcgctgtgcaaactatatatccctttttgtccacacaatgcaaggagaatatgacagccacctcccttggcccttccagggtacaatacgccttacaattcttgatcagtctgaagcacctgtaaggcaaaaccacgaagagataatggatgccaaaccagagctgcttgctttccagcgacccacaatcccacggaacccaaaaggttttggctatgtaacttttatgcatctggaagccctaagacaaagaactttcattaaggatgacacattattagtgcgctgtgaggtctccacccgctttgacatgggtagccttcggagggagggttttcagccacgaagtactgatgcaggggtatagcttgccctcacttgctcaaaaacaactacctggagaaaacagtgcctttccttgccctgttctcaataacatgcaaacaaacaagccacgggaaatatgtaatatctactagtgagtgttgttagagaggtcacttactatttcttcctgttacaaatgatctgaggcagttttttcctgggaatccacacgttccatgctttttcagaaatgttaggcctgaagtgcctgtggcatgttgcagcagctattttgccagttagtatacctctttgttgtactttcttgggcttttgctctggtgtattttattgtcagaaagtccagactcaagagtactaaacttttaataataatggattttccttaaaacttcagtctttttgtagtattatatgtaatatattaaaagtgaaaatcactaccgccttgtgctagtgccctcgagaagagttattgctctagaaagttgagttctcatttttttaacctgttatagatttcagaggatttgaaccataatccttggaaaacttaagttctcattcaccccagtttttcctccaggttgttactaaggatattcagggatgagtttaaaccctaaatataaccttaattatttagtgtaaacatgtctgttgaataatacttgtttaagtgtt

SEQ ID NO: 31741 - DNA, 4627 bp, Homo sapiens
agcagagaaggcggaagcagtggcgtccgcagctggggcttggcctgcgggcggccagcgaaggtggcgaaggctcccactggatccagagtttgccgtccaagcagcctcgtctcggcgcgcagtgtctgtgtccgtcctctaccagcgccttggctgagcggagtcgtgcggttggtgggggagccctgccctcctggttcggcctccccgcgcactagaacgagcaagtgataatcaagttactatgagtctgctaaactgtgaaaacagctgtggatccagccagtctgaaagtgactgctgtgtggccatggccagctcctgtagcgctgtaacaaaagatgatagtgtgggtggaactgccagcacggggaacctctccagctcatttatggaggagatccagggatatgatgtagagtttgacccacccctggaaagcaagtatgaatgccccatctgcttgatggcattacgagaagcagtgcaaacgccatgcggccataggttctgcaaagcctgcatcataaaatcaataagggatgcaggtcacaaatgtccagttgacaatgaaatactgctggaaaatcaactatttccagacaattttgcaaaacgtgagattctttctctgatggtgaaatgtccaaatgaaggttgtttgcacaagatggaactgagacatcttgaggatcatcaagcacattgtgagtttgctcttatggattgtccccaatgccagcgtcccttccaaaaattccatattaatattcacattctgaaggattgtccaaggagacaggtttcttgtgacaactgtgctgcatcaatggcatttgaagataaagagatccatgaccagaactgtcctttggcaaatgtcatctgtgaatactgcaatactatactcatcagagaacagatgcctaatcattatgatctagactgccctacagccccaattccatgcacattcagtacttttggttgccatgaaaagatgcagaggaatcacttggcacgccacctacaagagaacacccagtcacacatgagaatgttggcccaggctgttcatagtttgagcgttatacccgactctgggtatatctcagaggtccggaatttccaggaaactattcaccagttagagggtcgccttgtaagacaagaccatcaaatccgggagctgactgctaaaatggaaactcagagtatgtatgtaagtgagctcaaacgaaccattcgaacccttgaggacaaagttgctgaaatcgaagcacagcagtgcaatggaatttatatttggaagattggcaactttggaatgcatttgaaatgtcaagaagaggagaaacctgttgtgattcatagccctggattctacactggcaaacccgggtacaaactgtgcatgcgcttgcaccttcagttaccgactgctcagcgctgtgcaaactatatatccctttttgtccacacaatgcaaggagaatatgacagccacctcccttggcccttccagggtacaatacgccttacaattcttgatcagtctgaagcacctgtaaggcaaaaccacgaagagataatggatgccaaaccagagctgcttgctttccagcgacccacaatcccacggaacccaaaaggttttggctatgtaacttttatgcatctggaagccctaagacaaagaactttcattaaggatgacacattattagtgcgctgtgaggtctccacccgctttgacatgggtagccttcggagggagggttttcagccacgaagtactgatgcaggggtatagcttgccctcacttgctcaaaaacaactacctggagaaaacagtgcctttccttgccctgttctcaataacatgcaaacaaacaagccacgggaaatatgtaatatctactagtgagtgttgttagagaggtcacttactatttcttcctgttacaaatgatctgaggcagttttttcctgggaatccacacgttccatgctttttcagaaatgttaggcctgaagtgcctgtggcatgttgcagcagctattttgccagttagtatacctctttgttgtactttcttgggcttttgctctggtgtattttattgtcagaaagtccagactcaagagtactaaacttttaataataatggattttccttaaaacttcagtctttttgtagtattatatgtaatatattaaaagtgaaaatcactaccgccttgtgctagtgccctcgagaagagttattgctctagaaagttgagttctcatttttttaacctgttatagatttcagaggatttgaaccataatccttggaaaacttaagttctcattcaccccagtttttcctccaggttgttactaaggatattcagggatgagtttaaaccctaaatataaccttaattatttagtgtaaacatgtctgttgaataatacttgtttaagtgttccttctgccttgcttacttatttccttgaggttacgaagtagcatcttccccagagtttataatgctgagaaccacgtggataccaactgctcattgttatgctatgtaaccctttttgtctattcagtgcagagtgaatttcacagctctgcatatgtcttcatttgtttaatgcttacaagacaggagatgcacacatacaatcagcaacataaaaattaaaagtgacccaagtagtcagcgcatgtggcatctcattggtggtgacagaagctatgtgagccagaagttttcagctcttttgaataccctctggtttatttcgattaaaaagaacaaaattgatttcctaaaatcagaattttttaaaacttgggagatgattggagatacctaggaggtcaccaaactaggattagaagtcacagtggttgtatcacaacttagcttgagtatgttgctgtagcctaacaactgcaggttctgagaaggatcctgtagaatcctggaagtaaccagattttcctaatagggagatgatttttttgtgtgccatcatgtatttgttaaaggcctatatatagatataaaatatcgtggaatctagttctcagggagacccgcaactagtataagcttataaaggatctaaagatccatccaccatttaaagttgtctggtaatgagagatgacattgtatcccccagagaggccaaatcagagtcgccagccagcgttctagatcagccttaatttcaagagaaagccaaggacctcatctgcaggggagtgtggttttcagccccagcgagtgtcactttgaactttccctttgcttttttctctcttctccctccccacccacccttaggctcctgatctggtgagtttgttatggagtgaaaataaaagtcaagcagagaccttgtttcccgtgccaccattagtaccacaagctcatggctagttaccacattacttcctggcagtttgtgtccctcagctgtgccttccaaccagcgcctgagaatcactgcataccaccctctaggtagggaaacctacactgctgctgttcctgtgattattttacaatgaataaataattgtcaagttccatttaaaaactgaacagtagtatttttgtatttgcgtagaaaaagcctgaaggaaatatactaaactttttgttggcttattttcctttgcgcttgcttatattttttacattttctacaataaatgtgtacttttatcggagaaaaaaattaaatgttgccacaaaacatttaatctccacgcccccagctcaaaaaaggaaatgatatttaaaagcttcctggtcagatttctattaaaagcactggctgtgcattagatacaaagaggagtcatttcctgccttggtgatactatttttttctactaactcaagagtctttattaaaaaaaaaagttgttttgcctaatttcagcttttagcaagcttcccatctgtaaaatgatttggaccagatatttctagagtcccctccagccataacattctgtctcaaattaagttccaaccagcagaacaatgacaatacttaggaaagtattttgccagtataaaatgtctttaacttactctttgctgacactgatactttcctctaatttagtgtctatcagctgggtcacatcttaagtaaaatgagcaattttaacccccaacatttggcattttgtcataaaccagccagttattttatgctggtcattcatcttgactacaaagtagaatagtcaagctgtcattccaaatagaaaactttttacttcaatcagaattaagccttaacctggaaagttggtttcttccttacattttcccaatctcctactctattcttaaacatgctagtttcactcagttgggtatacaagcctttgggctttatgttgtatgttactaaccaccttttaccatatttatcttttggcatcattctgggacattgctaaattaaaaaagaaattgtttccacttttttctggagatgttcaactaaaggttgttttgttttgttttttgttttgagacagtctcaccctgacgctcaggctggagtgcagtggtgcaacctcggctcactgcaac

SEQ ID NO: 31742 - DNA, 3700 bp, Homo sapiens
cggctcgcgcgtctagtccctttcccggccggcggccgagggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacagggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccacgagggcagctgtgactacaggcctgtgcggtgtcccaacaaccccagctgccccccgctgctcaggatgaacctggaggcccacctcaaggagtgcgagcacatcaaatgcccccactccaagtacgggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttgacgtcctggacgaaaaccagagcaagctcagcgaggacctcatggagttccggcgggacgcatccatgttaaatgacgagctgtcccacatcaacgcgcggctgaacatgggcatcctaggctcctacgaccctcagcagatcttcaagtgcaaagggacctttgtgggccaccagggccctgtgtggtgtctctgcgtctactccatgggtgacctgctcttcagtggctcctctgacaagaccatcaaggtgtgggacacatgtaccacctacaagtgtcagaagacactggagggccatgatggcatcgtgctggctctctgcatccaggggtgcaaactctacagcggctctgcagactgcaccatcattgtgtgggacatccagaacctgcagaaggtgaacaccatccgggcccatgacaacccggtgtgcacgctggtctcctcacacaacgtgctcttcagcggctccctgaaggccatcaaggtctgggacatcgtgggcactgagctgaagttgaagaaggagctcacaggcctcaaccactgggtgcgggccctggtggctgcccagagctacctgtacagcggctcctaccagacaatcaagatctgggacatccgaacccttgactgcatccacgtcctgcagacgtctggtggcagcgtctactccattgctgtgacaaatcaccacattgtctgtggcacctacgagaacctcatccacgtgtgggacattgagtccaaggagcaggtgcggaccctcacgggccacgtgggcaccgtgtatgccctggcggtcatctcgacgccagaccagaccaaagtcttcagtgcatcctacgaccggtccctcagggtctggagtatggacaacatgatctgcacgcagaccctgctgcgtcaccagggcagtgtcaccgcgctggctgtgtcccggggccgactcttctcaggggctgtggatagcactgtgaaggtttggacttgctaacaggatccaggccaggctgtggtttcccctgaaccagccctggacctttctgagccaggctggccacatggggtggtctcggggtttctgcctgccccgtgggcataggtggacaggctctggcagccgggcagtgccctccccgtcccatgctcggcgagcctccctctactcggcactgtccttgctgcccagcccctctctgggtgccaggtacgacgcttgccccggcccaccctccatccccaccctccatccccaccctagatggagcgagggcctttttactcaccttttctaccgtttttagactgtatgtagatttggttacctcctggttgaaataaatgctccacagactgtggctgtgagtggggacagctcctcgggacaagggggctgtgtgtggccttgaggttggtgtgcacaggcactggctgctgtgagtgggggggcatggggcagtttcctttggtggaccccaggacttcggcccactccggggcctcccctccctgctaggaggcaactcgtcacacccaagctgctggcctccagtcccatctcccccaacacatgtgcccccaaaaagtgagccaggcacctctgtttcctgctgtttattgacagccgacggcagcgccttgcccagacctcccctgcccacctgctggagcccagcctgtgccgccctctgaggagaggcctggggggacagctgggcacgtccactcgcagggaaacacggggtgagacagcaggaaggggccctgcacgccgggacgccacctccgccagccgcctccacccgccccacaccacaatcgctggttttcggcattttttaaattttttttttaagaaacgtcaaagttgtgcccaacactgtggatcagcaaacacgatagaggagaccagtcagtacttcttggagggggcaggaggagagaggaaaagggagggcgagaatgaccacacaacacagccttggaccatgagcagaagcgtccgtgggaactccactggggtggatgggctgcctgcacagcccctggagagggggccaggcacaccctcagaggagctgcaagcccgtggcctggcctgctacatgccctgcttccacgtggctgccacgctgacacacccacattcaccaaacccacccgcgccctgggacgcagccacgccaggaggaggacacggccgccgagagcaaggcacaacctcgagttcttggggcgcagagaacttaggagagaagcacggaggagcccccggcagagcacccgcccccgggccccagccttccacctgtgctagcagcctggggcctccactctggccggaggaaggaccgcaggcagacagcctgggcctctaacagcttttgtccggagctagacttcgtgtcctttcagttggtaaatggttttctatagaatcaataatatttctttctttaaatatatatttgttaaagttatacctttttgtttctctggggaaatccgcctcagctcattcccaataaattaatactcttgatagctta

SEQ ID NO: 31743 - DNA, 2263 bp, Homo sapiens
cccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccga

SEQ ID NO: 31744 - DNA, 2052 bp, Homo sapiens
acgacatggcgcgcgagctgcgggcgctgctgctgtggggccgccgcctgcggcctttgctgcgggcgccggcgctggcggccgtgccgggaggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccg

SEQ ID NO: 31745 - DNA, 2785 bp, Homo sapiens
agtgagccgaggagccttcatagggacagccgcccctggtgcacacaccctcgtattctcctgcccttccccagccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtacaccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaaga

SEQ ID NO: 31746 - DNA, 3268 bp, Homo sapiens
atgcttacgtgccttttggcaggtcccctccctgttctggcctgtgttcccctcggcacaaggaaggggctgggtggtctctgtggctcgcctccgctctgaaattccggctttcaaggtggccccaggccttcgacaggggcttccggcgctgggagtgcggcaaggcgccgcgcaggcccgggacggtggccccagggaagtcgctcctagaggggaaggccgccgaagggacgagagacaccgcgggcccccggaaccgcaggcagccggtgtttacctcgctcggtcccaccccaggcggccgcgggcccgcccggagcgcgcggcgcgattgggcgagtggcctgccagtctccggggactttcccaggggtggggcggcccggccaggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcgggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtacaccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 31747 - DNA, 2586 bp, Homo sapiens
agtgagccgaggagccttcatagggacagccgcccctggtgcacacaccctcgtattctcctgcccttccccagccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaagccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtacaccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttg

SEQ ID NO: 31748 - DNA, 2200 bp, Homo sapiens
gactttcccaggggtggggcggcccggccaggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagccagctgatctcagattgccaagaaactagaagccacttgcacggtgtggccagagcctcagctggatgagaggctgagatgggtggccag

SEQ ID NO: 31749 - DNA, 1815 bp, Homo sapiens
gggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaagggcacacacagaggctgccccagacaccttccagagaggaaggttaagtgaggggttcagaaactgcatccttctgaactaaacagcaccgtggtggcagccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccag

SEQ ID NO: 31750 - DNA, 658 bp, Homo sapiens
acttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcgggaaaccgaggtacttggagcttgaggtcacacagctccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgc

SEQ ID NO: 31751 - DNA, 2680 bp, Homo sapiens
cgggtgccctgcccccgtccaggagccctaggagtgctacggggggccggagccttgcccgggccgctgccccgtccctggattcggggctggacgcagcaagcggggcgctgtgtccccaagctccccgtcctcgggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtacaccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 31752 - DNA, 575 bp, Homo sapiens
atacatactgttctgtgactccccgaaagagggattctctctacattctgaaatttgttgtccctatcctggtattgagaagtcaccttcctgatacaaaaagaaggaacaagttgggagaccacagtgactcaacgacaccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcag

SEQ ID NO: 31753 - DNA, 2274 bp, Homo sapiens
gactttcccaggggtggggcggcccggccaggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccag

SEQ ID NO: 31754 - DNA, 877 bp, Homo sapiens
agaagcacagtgagccgaggagccttcatagggacagccgcccctggtgcacacaccctcgtattctcctgcccttccccaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgca

SEQ ID NO: 31755 - DNA, 2238 bp, Homo sapiens
atgcaccaaggaaggagtgggccccttcttcactatggatggagaagcctcagagagtaagtggcaacagccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtacaccagtccctgaactgagctgtttacaggactggggaggctccacccagaaggctttcatttgtactctgctgggagtgact

SEQ ID NO: 31756 - DNA, 1743 bp, Homo sapiens
atggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaagccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctcc

SEQ ID NO: 31757 - DNA, 2711 bp, Homo sapiens
agtgagccgaggagccttcatagggacagccgcccctggtgcacacaccctcgtattctcctgcccttccccagccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagccagctgatctcagattgccaagaaactagaagccacttgcacggtgtggccagagcctcagctggatgagaggctgagatgggtggccagcttgtacaccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaaga

SEQ ID NO: 31758 - DNA, 1716 bp, Homo sapiens
atggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaagagtctccaaaaaatgaccgtgaggggcctcagtgagaccagattgtgtcatttggctccaccttcatcttgcagagccagctgatctcagattgccaagaaactagaagccacttgcacggtgtggcca

SEQ ID NO: 31759 - DNA, 2406 bp, Homo sapiens
agtgagccgaggagccttcatagggacagccgcccctggtgcacacaccctcgtattctcctgcccttccccagccaggcgggcaccacggcaggggctgagctaccctcatggaagggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtacaccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagc

SEQ ID NO: 31760 - DNA, 2489 bp, Homo sapiens
agtgagccgaggagccttcatagggacagccgcccctggtgcacacaccctcgtattctcctgcccttccccagccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtacaccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttg

SEQ ID NO: 31761 - DNA, 1748 bp, Homo sapiens
agtgagccgaggagccttcatagggacagccgcccctggtgcacacaccctcgtattctcctgcccttccccagccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaagggcacacacagaggctgccccagacaccttccagagaggaaggttaagtga

SEQ ID NO: 31762 - DNA, 1974 bp, Homo sapiens
ggaaagttccgggaagggcggcagccggcggggcccgggcgcggaagttgccggcggccgcgcggcctcccgggcgggcctacagccatgtcccgggacccggggtcgggcggctgggaggaggccccgcgcgcagctgccgcgctctgcaccctgtaccacgaggccggacagcggctgcgccgcctgcaggaccagctcgctgcccgcgacgccctcatcgctcgcctccgcgcccgcctggccgcgctggagggggacgccgcgccgtccctagtggacgcgctgctggagcaggttgcgcgcttccgggagcagctgcgaaggcaggagggcggcgccgccgaggcccagatgcgccaggaaattgagaggctgactgagcgactagaagaaaaagagagggagatgcagcagctgctgagccagccccaacacgagcgagagaaggaagtcgtcctgctacggaggagcatggcagaaggggagcgcgcccgggccgccagtgacgtcctgtgccgctccttggccaacgagacccatcagctgcggaggacgctgaccgccaccgcccacatgtgtcagcatctggccaagtgtctggatgaacgacagcatgcacaaaggaatgtgggggagagaagtcctgaccagtcggaacacacagatgggcacacctctgtccagagtgttattgagaagttgcaggaagaaaatcgactgttaaaacagaaggtgactcacgttgaagacctcaatgccaagtggcagcgctacaacgccagcagggacgaatacgtgagggggctccatgcgcagctcagggggctgcagatcccccacgagcccgagctgatgaggaaggagatctcccggctcaacagacagttggaagagaaaataaatgactgtgccgaagtgaagcaggagctggcggcctccaggacggcccgggatgctgcgttggagcgggtgcagatgctggaacagcagattctcgcttacaaggatgacttcatgtcagaaagggccgatcgggaacgggctcaaagtaggattcaagaactggaggaaaaggtcgcctctttgctgcaccaggtgtcctggagacaggattctcgagagccagacgccggccggattcacgctgggagcaaaactgccaagtatttggccgccgacgcattagagcttatggtgcctggtggctggaggcctgggactgggtcccagcagccagaaccccctgcagagggcgggcatcctggcgcggcccagagaggccagggggaccttcagtgccctcactgcctgcagtgcttcagtgacgagcaaggggaagagctcctcaggcatgtggctgagtgctgccagtgaccgagactcacccgtgcccttgcggcctcctggcccggtgcagctgccctcagggacagggtgggtgctctcagatgccatgggttgagctctactgagagccaaggcccctagaatagttgcggggcactctgatcgttcactttggtccctttggctatggaacaggctgggtcacagggaactgccagtgaggctggaggctggaggtggagatggggtcaggaacatctggcagagggaggtcccagtctgtgtctccatcaggcttaagccagagctatctggtgctggtgtgccagcccctcccccagcctgcctagaaaggggtggctgcctgagggagtcacttgtatggtccccagggtgggagccccatcctgttctatggaataaagcgtcgcctctctgcctcgaaccagtcaaatggagtattgcggctgcacgtcacactagggtggccacccccgccattgcgagccacatgtctgcactgagaaactgcatttcagtagcatttgtcatccagccggaagttaaagcacacttactttattcacctatttttataataaacgttcttgctgctgtgactgc

SEQ ID NO: 31763 - DNA, 2006 bp, Homo sapiens
agttgccggcggccgcgcggcctcccgggcgggcctacagccatgtcccgggacccggggtcgggcggctgggaggaggccccgcgcgcagctgccgcgctctgcaccctgtaccacgaggccggacagcggctgcgccgcctgcaggaccagctcgctgcccgcgacgccctcatcgctcgcctccgcgcccgcctggccgcgctggagggggacgccgcgccgtccctagtggacgcgctgctggagcaggttgcgcgcttccgggagcagctgcgaaggcaggagggcggcgccgccgaggcccagatgcgccaggtacgagggcgggtaccagaggagctgcgggagcgagagtgcgtgtggcggccgccgggtcctgggaaattgagaggctgactgagcgactagaagaaaaagagagggagatgcagcagctgctgagccagccccaacacgagcgagagaaggaagtcgtcctgctacggaggagcatggcagaaggggagcgcgcccgggccgccagtgacgtcctgtgccgctccttggccaacgagacccatcagctgcggaggacgctgaccgccaccgcccacatgtgtcagcatctggccaagtgtctggatgaacgacagcatgcacaaaggaatgtgggggagagaagtcctgaccagtcggaacacacagatgggcacacctctgtccagagtgttattgagaagttgcaggaagaaaatcgactgttaaaacagaaggtgactcacgttgaagacctcaatgccaagtggcagcgctacaacgccagcagggacgaatacgtgagggggctccatgcgcagctcagggggctgcagatcccccacgagcccgagctgatgaggaaggagatctcccggctcaacagacagttggaagagaaaataaatgactgtgccgaagtgaagcaggagctggcggcctccaggacggcccgggatgctgcgttggagcgggtgcagatgctggaacagcagattctcgcttacaaggatgacttcatgtcagaaagggccgatcgggaacgggctcaaagtaggattcaagaactggaggaaaaggtcgcctctttgctgcaccaggtgtcctggagacaggattctcgagagccagacgccggccggattcacgctgggagcaaaactgccaagtatttggccgccgacgcattagagcttatggtgcctggtggctggaggcctgggactgggtcccagcagccagaaccccctgcagagggcgggcatcctggcgcggcccagagaggccagggggaccttcagtgccctcactgcctgcagtgcttcagtgacgagcaaggggaagagctcctcaggcatgtggctgagtgctgccagtgaccgagactcacccgtgcccttgcggcctcctggcccggtgcagctgccctcagggacagggtgggtgctctcagatgccatgggttgagctctactgagagccaaggcccctagaatagttgcggggcactctgatcgttcactttggtccctttggctatggaacaggctgggtcacagggaactgccagtgaggctggaggctggaggtggagatggggtcaggaacatctggcagagggaggtcccagtctgtgtctccatcaggcttaagccagagctatctggtgctggtgtgccagcccctcccccagcctgcctagaaaggggtggctgcctgagggagtcacttgtatggtccccagggtgggagccccatcctgttctatggaataaagcgtcgcctctctgcctcgaaccagtcaaatggagtattgcggctgcacgtcacactagggtggccacccccgccattgcgagccacatgtctgcactgagaaactgcatttcagtagcatttgtcatccagccggaagttaaagcacacttactttattcacctatttttataataaacgttcttgctgctgtgactgctctgagaatttg

SEQ ID NO: 31764 - DNA, 2338 bp, Homo sapiens
gggtagctgcggccgcagcagcggcggcgggcatggcagaggcgcgatcccagccctcggcggggccgcagctcaacgcgctaccggaccactctccgttgctgcagccgggcctggcggcgctgcggcgccgggcccgggaagctggcgtcccgctcgcgccgctgccgctcaccgactccttcctgctgcggttcctgcgcgcccgggatttcgatctggacctggcctggcggttactaaaaaactattataagtggagagcagaatgtccagaaataagtgcagatctacaccctagaagtattattggcctcctaaaggctggctaccatggagtcctgagatccagggatcccactggcagcaaagttcttatttacagaatcgcacactgggaccccaaagtttttacagcttatgacgtatttcgagtaagtctaatcacatccgagcttattgtacaggaggtagaaactcagcggaatggaatcaaggctatctttgatctggaaggttggcagttttctcatgcttttcaaatcactccatccgtagccaagaagattgctgctgtacttacggattcatttccattgaaagttcgtggcatccatttgataaatgaaccagtaattttccatgctgtcttttccatgatcaaaccattcctgactgaaaaaattaaggaacggattcacatgcatgggaacaactacaaacaaagcttgcttcagcatttcccagacattcttcctctggaatatggtggtgaagaattctccatggaggacatttgtcaggaatggacaaattttataatgaagtctgaagattatctcagcagcatttctgagagcattcaatgagaagttatgtcatgtgaatggcttcctaactaaaaatacatgagtgatatccaacctggttaaatgaatgaaagaaaaggagcaaatcttttaaactaatgcttgcctgaactttaaaaatgtagaaatcttctgacatgagcaacacaggtgtttggaaagattttttactttttaaatgcttttttctctacttttgaagtaattaaatgtcagtacattttaagagcataaaaatcggcgattttgtacttgaagagaacatgaaagttattgctaaagtagctgctcatgtgcatctttgtatgtttctagaaagttatattttaaacaagttctctgattaaattggtttagaaaaaaatttagaaatattccgcttaaaaatactagcacaagtcagctaatgataaaaaaattaacacttgttttaagtggatgtcagattaaattataattcattataattaaaatctgaatagagttttatggttattcctgtggaccagcaagacatttcatctcagggaaattttattttagtatattaacacgatagaaactttttttttttttttcagacagagtcttgctctgtcgcccaggctagagtgcagtagtgagatctcagctcactgcaacctctgctaggattacatgtgcacaccaccactcctggctaagttttgtattttatatagagatggggttttgccacgttggccaagctggtctcaaactcctgaactcaagtaatttgcctgcttcggcctcccagagtcctgggattacagtcgtgagccatcgcgcctggccgtgatagaaactttcagctgaggagtctatatgccatactactctatgtggcatctttaggtctctgtgaaatcatgttgatgtaattgattaacaaaaataatttagaaaatacgtcaggcacagttgatggcttctcaatatctgctttgcatttttaaacaaatcaagaatgtaattttaacttttgcttatggtcattcttatgactacacggaaagggatggaatcatacttacttgtcttatacatggactgtttttagttaacaataacgtaactacacaaaggaaaggaaatgtttacattttaaaaaattactgtcaattacatctggtatttttcagattatgcataaaataatatgagtttgactattgtatcagaatattttaatcaaatcctgcaatttatattaacttaaaaaaacatctggtaaagactgggtgtggcagctcacacctgtaatcccagcactttgggaggccgaggctggatggatgattgcttgagcgcaggagttctagaccagcctgggcaatacagggagaccctgtctctatttcaaaaataaataaataggccccggtgtgtgatgttccccttcctgtgtccatgtgttctcaaaaaaaattaaaaaataaaaataaaaa

SEQ ID NO: 31765 - DNA, 2847 bp, Homo sapiens
acagactgccaaatggaacagacaagcaggttgtcttgtgttaaagaaaatgagatataagtcagttactcccggaggcaatgctgctgttcagctcttctgtttttgtggccagggtcttcatgaacactaataggggtaccaggccctcttcctcgttagaagaaatcaggataacaaaggcatattgggcacccctacaaaaggaatctgtatctgtatcaagatgatctgaagaacagcttctacctttaggaatgtctagtgttccaaaatgactagcatcttccattttgccattatcttcatgttaatacttcagatcagaatacaattatctgaagaaagtgaatttttagttgataggtcaaaaaacggtctcatccacgttcctaaagacctatcccagaaaacaacaatcttaaatatatcgcaaaattatatatctgagctttggacttctgacatcttatcactgtcaaaactgaggattttgataatttctcataatagaatccagtatcttgatatcagtgttttcaaattcaaccaggaattggaatacttggatttgtcccacaacaagttggtgaagatttcttgccaccctactgtgaacctcaagcacttggacctgtcatttaatgcatttgatgccctgcctatatgcaaagagtttggcaatatgtctcaactaaaatttctggggttgagcaccacacacttagaaaaatctagtgtgctgccaattgctcatttgaatatcagcaaggtcttgctggtcttaggagagacttatggggaaaaagaagaccctgagggccttcaagactttaacactgagagtctgcacattgtgttccccacaaacaaagaattccattttattttggatgtgtcagtcaagactgtagcaaatctggaactatctaatatcaaatgtgtgctagaagataacaaatgttcttacttcctaagtattctggcgaaacttcaaacaaatccaaagttatcaaatcttaccttaaacaacattgaaacaacttggaattctttcattaggatcctccagctggtttggcatacaactgtatggtatttctcaatttcaaacgtgaagctacagggtcagctggacttcagagattttgattattctggcacttccttgaaggccttgtctatacaccaagttgtcagcgatgtgttcggttttccgcaaagttatatctatgaaatcttttcgaatatgaacatcaaaaatttcacagtgtctggtacacgcatggtccacatgctttgcccatccaaaattagcccgttcctgcatttggatttttccaataatctcttaacagacacggtttttgaaaattgtgggcaccttactgagttggagacacttattttacaaatgaatcaattaaaagaactttcaaaaatagctgaaatgactacacagatgaagtctctgcaacaattggatattagccagaattctgtaagctatgatgaaaagaaaggagactgttcttggactaaaagtttattaagtttaaatatgtcttcaaatatacttactgacactattttcagatgtttacctcccaggatcaaggtacttgatcttcacagcaataaaataaagagcattcctaaacaagtcgtaaaactggaagctttgcaagaactcaatgttgctttcaattctttaactgaccttcctggatgtggcagctttagcagcctttctgtattgatcattgatcacaattcagtttcccacccatcggctgatttcttccagagctgccagaagatgaggtcaataaaagcaggggacaatccattccaatgtacctgtgagctaggagaatttgtcaaaaatatagaccaagtatcaagtgaagtgttagagggctggcctgattcttataagtgtgactacccggaaagttatagaggaaccctactaaaggactttcacatgtctgaattatcctgcaacataactctgctgatcgtcaccatcgttgccaccatgctggtgttggctgtgactgtgacctccctctgcagctacttggatctgccctggtatctcaggatggtgtgccagtggacccagacccggcgcagggccaggaacatacccttagaagaactccaaagaaatctccagtttcatgcatttatttcatatagtgggcacgattctttctgggtgaagaatgaattattgccaaacctagagaaagaaggtatgcagatttgccttcatgagagaaactttgttcctggcaagagcattgtggaaaatatcatcacctgcattgagaagagttacaagtccatctttgttttgtctcccaactttgtccagagtgaatggtgccattatgaactctactttgcccatcacaatctctttcatgaaggatctaatagcttaatcctgatcttgctggaacccattccgcagtactccattcctagcagttatcacaagctcaaaagtctcatggccaggaggacttatttggaatggcccaaggaaaagagcaaacgtggccttttttgggctaacttaagggcagccattaatattaagctgacagagcaagcaaagaaatagattacacatcaagtgaaaaatattcctcctgttgatattgctgcttttggaagttccaacaatgactttattttgcatcagcatagatgtaaacacaattgtgagtgtatgatgtaggtaaaaatatataccttcgggtcgcagttcaccatttatatgtggtattaaaaattaatgaaatgatataactttgatttaaacagttctgacac

SEQ ID NO: 31766 - DNA, 2779 bp, Homo sapiens
agaaaatgagatataagtcagttactcccggaggcaatgctgctgttcagctcttctgtttttgtggccagggtcttcatgaacactaataggggtaccaggccctcttcctcgttagaagaaatcaggataacaaaggcatattgggcacccctacaaaaggaatctgtatctgtatcaagatgatctgaagaacagcttctacctttaggaatgtctagtgttccaaaatgactagcatcttccattttgccattatcttcatgttaatacttcagatcagaatacaattatctgaagaaagtgaatttttagttgataggtcaaaaaacggtctcatccacgttcctaaagacctatcccagaaaacaacaatcttaaatatatcgcaaaattatatatctgagctttggacttctgacatcttatcactgtcaaaactgaggattttgataatttctcataatagaatccagtatcttgatatcagtgttttcaaattcaaccaggaattggaatacttggatttgtcccacaacaagttggtgaagatttcttgccaccctactgtgaacctcaagcacttggacctgtcatttaatgcatttgatgccctgcctatatgcaaagagtttggcaatatgtctcaactaaaatttctggggttgagcaccacacacttagaaaaatctagtgtgctgccaattgctcatttgaatatcagcaaggtcttgctggtcttaggagagacttatggggaaaaagaagaccctgagggccttcaagactttaacactgagagtctgcacattgtgttccccacaaacaaagaattccattttattttggatgtgtcagtcaagactgtagcaaatctggaactatctaatatcaaatgtgtgctagaagataacaaatgttcttacttcctaagtattctggcgaaacttcaaacaaatccaaagttatcaaatcttaccttaaacaacattgaaacaacttggaattctttcattaggatcctccagctggtttggcatacaactgtatggtatttctcaatttcaaacgtgaagctacagggtcagctggacttcagagattttgattattctggcacttccttgaaggccttgtctatacaccaagttgtcagcgatgtgttcggttttccgcaaagttatatctatgaaatcttttcgaatatgaacatcaaaaatttcacagtgtctggtacacgcatggtccacatgctttgcccatccaaaattagcccgttcctgcatttggatttttccaataatctcttaacagacacggtttttgaaaattgtgggcaccttactgagttggagacacttattttacaaatgaatcaattaaaagaactttcaaaaatagctgaaatgactacacagatgaagtctctgcaacaattggatattagccagaattctgtaagctatgatgaaaagaaaggagactgttcttggactaaaagtttattaagtttaaatatgtcttcaaatatacttactgacactattttcagatgtttacctcccaggatcaaggtacttgatcttcacagcaataaaataaagagcattcctaaacaagtcgtaaaactggaagctttgcaagaactcaatgttgctttcaattctttaactgaccttcctggatgtggcagctttagcagcctttctgtattgatcattgatcacaattcagtttcccacccatcggctgatttcttccagagctgccagaagatgaggtcaataaaagcaggggacaatccattccaatgtacctgtgagctaggagaatttgtcaaaaatatagaccaagtatcaagtgaagtgttagagggctggcctgattcttataagtgtgactacccggaaagttatagaggaaccctactaaaggactttcacatgtctgaattatcctgcaacataactctgctgatcgtcaccatcgttgccaccatgctggtgttggctgtgactgtgacctccctctgcagctacttggatctgccctggtatctcaggatggtgtgccagtggacccagacccggcgcagggccaggaacatacccttagaagaactccaaagaaatctccagtttcatgcatttatttcatatagtgggcacgattctttctgggtgaagaatgaattattgccaaacctagagaaagaaggtatgcagatttgccttcatgagagaaactttgttcctggcaagagcattgtggaaaatatcatcacctgcattgagaagagttacaagtccatctttgttttgtctcccaactttgtccagagtgaatggtgccattatgaactctactttgcccatcacaatctctttcatgaaggatctaatagcttaatcctgatcttgctggaacccattccgcagtactccattcctagcagttatcacaagctcaaaagtctcatggccaggaggacttatttggaatggcccaaggaaaagagcaaacgtggccttttttgggctaacttaagggcagccattaatattaagctgacagagcaagcaaagaaatagattacacatcaagtgaaaaatattcctcctgttgatattgctgcttttggaagttccaacaatgactttattttgcatcagcatagatgtaaacacaattgtgagtgtatgatgtaggtaaaaatatataccttcgggtcgcagttcaccatttatatgtggtattaaaaattaatgaaatgatataa

SEQ ID NO: 31767 - DNA, 648 bp, Homo sapiens
gttttcaacaccaaatgtggttaacagtgaaataaattcaaggaagtgcttgaatttcttacagactgccaaatggaacagacaagcaggttgtcttgaatctgtatctgtatcaagatgatctgaagaacagcttctacctttaggaatgtctagtgttccaaaatgactagcatcttccattttgccattatcttcatgttaatacttcagatcagaatacaattatctgaagaaagtgaatttttagttgataggtcaaaaaacggtctcatccacgttcctaaagacctatcccagaaaacaacaatcttaaatatatcgcaaaattatatatctgagctttggacttctgacatcttatcactgtcaaaactgaggattttgataatttctcataatagaatccagtatcttgatatcagtgttttcaaattcaaccaggaattggaatacttggatttgtcccacaacaagttggtgaagatttcttgccaccctactgtgaacctcaagcacttggacctgtcatttaatgcatttgatgccctgcctatatgcaaagagtttggcaatatgtctcaactaaaatttctggggttgagcaccacacacttagaaaaatctagtgtgctgccaattgctcat

SEQ ID NO: 31768 - DNA, 555 bp, Homo sapiens
aattgtatttccgttcatttacaagttattttctcttcttctgaaaaagagatcttgtggatggatgaaaaggcaagaggaaaaacaaagcagccgaaacacacccagacgcacacttctgccaagcatagccaccacgactgccaaatggaacagacaagcaggttgtcttgtgttaaagaaaatgagatataagtcagttactcccggaggcaatgctgctgttcagctcttctgtttttgtggccagggtcttcatgaacactaataggggtaccaggccctcttcctcgttagaagaaatcaggataacaaaggcatattgggcacccctacaaaaggaatctgtatctgtatcaagatgatctgaagaacagcttctacctttaggaatgtctagtgttccaaaatgactagcatcttccattttgccattatcttcatgttaatacttcagatcagaatacaattatctgaagaaagtgaatttttagttgataggtcaaaaaacggtctcatccacgttcctaaagacctatcccagaaaacaacaat

SEQ ID NO: 31769 - DNA, 605 bp, Homo sapiens
atagctttatttgcccatttattgtgttgttattttgttgttgtcattactggaaaaggcaagagtagagctatcagaatgtcttccttgaacatgctgtcaacaaaccccaggatttttataaaccctatgtgaaaaacacgctaagaatctcttttcttcttagcatatttttcacttagggtttacaaaaatatgttttgaagaaagcttgaaaagatcagtggaaaaaaattcagcaccaaattttctctgaaaatcaacttgtcaaaaaagacgtgattaacatccatcctgtaaccagcacatgaatgatcttccctctttacgagtgtgcttcagcaaaactttaatctcgacccctccctctttccacttttaatagtggatggatgaaaaggcaagaggaaaaacaaagcagccgaaacacacccagacgcacacttctgccaagcatagccaccacgaatctgtatctgtatcaagatgatctgaagaacagcttctacctttaggaatgtctagtgttccaaaatgactagcatcttccattttgccattatcttcatgttaatacttcagatcagaatacaattatctgaaga

SEQ ID NO: 31770 - DNA, 578 bp, Homo sapiens
aactatgtaatgtaattccagtggaattcggtaggtggcataaaacagcctttttgttttgttttgttttcaacaccaaatgtggttaacagtgaaataaattcaaggaagtgcttgaatttcttacagactgccaaatggaacagacaagcaggttgtcttgtgttaaagaaaatgagatataagtcagttactcccggaggcaatgctgctgttcagctcttctgtttttgtggccagaatctgtatctgtatcaagatgatctgaagaacagcttctacctttaggaatgtctagtgttccaaaatgactagcatcttccattttgccattatcttcatgttaatacttcagatcagaatacaattatctgaagaaagtgaatttttagttgataggtcaaaaaacggtctcatccacgttcctaaagacctatcccagaaaacaacaatcttaaatatatcgcaaaattatatatctgagctttggacttctgacatcttatcactgtcaaaactgaggattttgataatttctcataatagaatccagtatcttgatatcagtgttttcaaat

SEQ ID NO: 31771 - DNA, 4200 bp, Homo sapiens
aagcactaatggactaagacaaaaagattccattatgaaagtgaaaaggcaaccgcagagtggcagaagcttttggagatgatgaatatgtttacttcctggattgcggtgatgataccatgagtgtatacatatgtgtgtatacataatgtatacaaattgtgttcattgattatgtacagtttctttgtataccaattataccttaataaagctaaggaaaaaaaaaagaaaatccagaataaatatgcatggtatgacccatttatttaaaaaaaaaaagagggaatgcgaagcagtggttttggtgcgaacacaaaaattctggcttcaacagcatttaaattcccaaaccaagcatgtttgtgttttaattctttgtggccataaattgtacagctcaggcctttatagtctctcagattctgtgaatgtggggaattagttttactcataaaaagttttgttcttggggataaattttttaaaaaaatttttgtatagttagcacactgagaaaatacagacaaaggcatacagatgcaagaaatgaggtagctgaatagaccaaagaatgatatagggcccagaaggtaggcaaagagaaagttgttgggtttatggttacaagtaaactagcagttgtggtgcagatagttttatttcccccacattaatctgaacagcccatccagacttaaacactgctttttgcatttacttctaggcaggaagacagggttctgatggtgtgagtctccttcaactcagcaaaccaccttggtctgcctcgagtttccaacacccctcctgcctgctagtgataggtgtgaggcaggttgatgaacatggaacttttttcttttggtcccaaagcatgctactcctggagtttcattcagtgaatgagaactatagtttggttctgtgagatctctatgaatcaaggcggccactgaagcggagaaaagaaatgcttaaatgttaagaaagtttgaagtgcagaaaaaggtgattgtaaatccatatggttaagcttagcccatttcttaaaaggcttgattgctcattcctccattcattgatttactcactcttccaatccatgttattgagtcttgctctgtaattccggatggttgtgcttttaagtactgcatagtggttgtatgtctgtgttagcattgctgaatgtatcagggaattcatttttttatccccattcattcgttccattcatctgtttctctctctctctctctttgtgtgtgtgtgtgtgtgtgtgtgtgtgtgtgtgtgtgtgtgtgttatgcctagaaaacatttctcaagaattagaattacgatatgctgtcaaacacaatgacttatttgaacctcttttatttgtaggttgaagcactggacaatgccacatactttgtggatggtgtgggtcttgggggtcatcatcagcctctccaaggaagaatcctccaatcaggcttctctgtcttgtgaccgcaatggtatctgcaagggcagctcaggatctttaaactccattccctcagggctcacagaagctgtaaaaagccttgacctgtccaacaacaggatcacctacattagcaacagtgacctacagaggtgtgtgaacctccaggctctggtgctgacatccaatggaattaacacaatagaggaagattctttttcttccctgggcagtcttgaacatttagacttatcctataattacttatctaatttatcgtcttcctggttcaagcccctttcttctttaacattcttaaacttactgggaaatccttacaaaaccctaggggaaacatctcttttttctcatctcacaaaattgcaaatcctgagagtgggaaatatggacaccttcactaagattcaaagaaaagattttgctggacttaccttccttgaggaacttgagattgatgcttcagatctacagagctatgagccaaaaagtttgaagtcaattcagaatgtaagtcatctgatccttcatatgaagcagcatattttactgctggagatttttgtagatgttacaagttccgtggaatgtttggaactgcgagatactgatttggacactttccatttttcagaactatccactggtgaaacaaattcattgattaaaaagtttacatttagaaatgtgaaaatcaccgatgaaagtttgtttcaggttatgaaacttttgaatcagatttctggattgttagaattagagtttgatgactgtacccttaatggagttggtaattttagagcatctgataatgacagagttatagatccaggtaaagtggaaacgttaacaatccggaggctgcatattccaaggttttacttattttatgatctgagcactttatattcacttacagaaagagttaaaagaatcacagtagaaaacagtaaagtttttctggttccttgtttactttcacaacatttaaaatcattagaatacttggatctcagtgaaaatttgatggttgaagaatacttgaaaaattcagcctgtgaggatgcctggccctctctacaaactttaattttaaggcaaaatcatttggcatcattggaaaaaaccggagagactttgctcactctgaaaaacttgactaacattgatatcagtaagaatagttttcattctatgcctgaaacttgtcagtggccagaaaagatgaaatatttgaacttatccagcacacgaatacacagtgtaacaggctgcattcccaagacactggaaattttagatgttagcaacaacaatctcaatttattttctttgaatttgccgcaactcaaagaactttatatttccagaaataagttgatgactctaccagatgcctccctcttacccatgttactagtattgaaaatcagtaggaatgcaataactacgttttctaaggagcaacttgactcatttcacacactgaagactttggaagctggtggcaataacttcatttgctcctgtgaattcctctccttcactcaggagcagcaagcactggccaaagtcttgattgattggccagcaaattacctgtgtgactctccatcccatgtgcgtggccagcaggttcaggatgtccgcctctcggtgtcggaatgtcacaggacagcactggtgtctggcatgtgctgtgctctgttcctgctgatcctgctcacgggggtcctgtgccaccgtttccatggcctgtggtatatgaaaatgatgtgggcctggctccaggccaaaaggaagcccaggaaagctcccagcaggaacatctgctatgatgcatttgtttcttacagtgagcgggatgcctactgggtggagaaccttatggtccaggagctggagaacttcaatccccccttcaagttgtgtcttcataagcgggacttcattcctggcaagtggatcattgacaatatcattgactccattgaaaagagccacaaaactgtctttgtgctttctgaaaactttgtgaagagtgagtggtgcaagtatgaactggacttctcccatttccgtctttttgatgagaacaatgatgctgccattctcattcttctggagcccattgagaaaaaagccattccccagcgcttctgcaagctgcggaagataatgaacaccaagacctacctggagtggcccatggacgaggctcagcgggaaggattttgggtaaatctgagagctgcgataaagtcctaggttcccatatttaagaccagtctttgtctagttgggatctttatgtcactagttatagttaagttcattcagacataattatataaaaactacgtggatgtaccgtcatttgaggacttgcttactaaaactacaaaacttcaaattttgtctggggtgctgttttataaacatatgccagatttaaaaattggtttttggtttttcttttttctatgagataaccatgatcataagtctattactgatatctgaatatagtcccttggtatccaagggaattggttgcaggatcctcgtggatatcaaaattcatagatgatcaagtcccttataagagtggcatagtatttgcatataacctgtgtacattctcctgtatactttaaatcatctctagattacttatgatacccaatacaatgtaaatactatgt

SEQ ID NO: 31772 - DNA, 3047 bp, Homo sapiens
tttcactttcgagagtgccgtctatttgccacacacttccctgatgaaatgtctggatttggactaaagaaaaaaggaaaggctagcagtcatccaacagaatcatgagacagactttgccttgtatctacttttgggggggccttttgccctttgggatgctgtgtgcatcctccaccaccaagtgcactgttagccatgaagttgctgactgcagccacctgaagttgactcaggtacccgatgatctacccacaaacataacagtgttgaaccttacccataatcaactcagaagattaccagccgccaacttcacaaggtatagccagctaactagcttggatgtaggatttaacaccatctcaaaactggagccagaattgtgccagaaacttcccatgttaaaagttttgaacctccagcacaatgagctatctcaactttctgataaaacctttgccttctgcacgaatttgactgaactccatctcatgtccaactcaatccagaaaattaaaaataatccctttgtcaagcagaagaatttaatcacattagatctgtctcataatggcttgtcatctacaaaattaggaactcaggttcagctggaaaatctccaagagcttctattatcaaacaataaaattcaagcgctaaaaagtgaagaactggatatctttgccaattcatctttaaaaaaattagagttgtcatcgaatcaaattaaagagttttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtggttggtaacgattcctttgcttggcttccacaactagaatatttcttcctagagtataataatatacagcatttgttttctcactctttgcacgggcttttcaatgtgaggtacctgaatttgaaacggtcttttactaaacaaagtatttcccttgcctcactccccaagattgatgatttttcttttcagtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaagaataaaatctcaaaaatagagagtgatgctttctcttggttgggccacctagaagtacttgacctgggccttaatgaaattgggcaagaactcacaggccaggaatggagaggtctagaaaatattttcgaaatctatctttcctacaacaagtacctgcagctgactaggaactcctttgccttggtcccaagccttcaacgactgatgctccgaagggtggcccttaaaaatgtggatagctctccttcaccattccagcctcttcgtaacttgaccattctggatctaagcaacaacaacatagccaacataaatgatgacatgttggagggtcttgagaaactagaaattctcgatttgcagcataacaacttagcacggctctggaaacacgcaaaccctggtggtcccatttatttcctaaagggtctgtctcacctccacatccttaacttggagtccaacggctttgacgagatcccagttgaggtcttcaaggatttatttgaactaaagatcatcgatttaggattgaataatttaaacacacttccagcatctgtctttaataatcaggtgtctctaaagtcattgaaccttcagaagaatctcataacatccgttgagaagaaggttttcgggccagctttcaggaacctgactgagttagatatgcgctttaatccctttgattgcacgtgtgaaagtattgcctggtttgttaattggattaacgagacccataccaacatccctgagctgtcaagccactacctttgcaacactccacctcactatcatgggttcccagtgagactttttgatacatcatcttgcaaagacagtgccccctttgaactctttttcatgatcaataccagtatcctgttgatttttatctttattgtacttctcatccactttgagggctggaggatatctttttattggaatgtttcagtacatcgagttcttggtttcaaagaaatagacagacagacagaacagtttgaatatgcagcatatataattcatgcctataaagataaggattgggtctgggaacatttctcttcaatggaaaaggaagaccaatctctcaaattttgtctggaagaaagggactttgaggcgggtgtttttgaactagaagcaattgttaacagcatcaaaagaagcagaaaaattatttttgttataacacaccatctattaaaagacccattatgcaaaagattcaaggtacatcatgcagttcaacaagctattgaacaaaatctggattccattatattggttttccttgaggagattccagattataaactgaaccatgcactctgtttgcgaagaggaatgtttaaatctcactgcatcttgaactggccagttcagaaagaacggataggtgcctttcgtcataaattgcaagtagcacttggatccaaaaactctgtacattaaatttatttaaatattcaattagcaaaggagaaactttctcaatttaaaaagttctatggcaaatttaagttttccataaaggtgttataatttgtttattcatatttgtaaatgattatattctatcacaattacatctcttctaggaaaatgtgtctccttatttcaggcctatttttgacaattgacttaattttacccaaaataaaacatataagcacgtaagaa

SEQ ID NO: 31773 - DNA, 2310 bp, Homo sapiens
aagacacaaccaggaactgccccaggagtgacttcacgagcagtttattcattgcaattgttctcatggtgataaagaaaaagtaccaggagatggatcctggactggaaggtcagagaagcctccctgaaaaggtggcatctaagctgaggctgtgaatgctgagcagaagttagcccgtggccaggggaggtcagaggctggagtaagagttttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtggttggtaacgattcctttgcttggcttccacaactagaatatttcttcctagagtataataatatacagcatttgttttctcactctttgcacgggcttttcaatgtgaggtacctgaatttgaaacggtcttttactaaacaaagtatttcccttgcctcactccccaagattgatgatttttcttttcagtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaagaataaaatctcaaaaatagagagtgatgctttctcttggttgggccacctagaagtacttgacctgggccttaatgaaattgggcaagaactcacaggccaggaatggagaggtctagaaaatattttcgaaatctatctttcctacaacaagtacctgcagctgactaggaactcctttgccttggtcccaagccttcaacgactgatgctccgaagggtggcccttaaaaatgtggatagctctccttcaccattccagcctcttcgtaacttgaccattctggatctaagcaacaacaacatagccaacataaatgatgacatgttggagggtcttgagaaactagaaattctcgatttgcagcataacaacttagcacggctctggaaacacgcaaaccctggtggtcccatttatttcctaaagggtctgtctcacctccacatccttaacttggagtccaacggctttgacgagatcccagttgaggtcttcaaggatttatttgaactaaagatcatcgatttaggattgaataatttaaacacacttccagcatctgtctttaataatcaggtgtctctaaagtcattgaaccttcagaagaatctcataacatccgttgagaagaaggttttcgggccagctttcaggaacctgactgagttagatatgcgctttaatccctttgattgcacgtgtgaaagtattgcctggtttgttaattggattaacgagacccataccaacatccctgagctgtcaagccactacctttgcaacactccacctcactatcatgggttcccagtgagactttttgatacatcatcttgcaaagacagtgccccctttgaactctttttcatgatcaataccagtatcctgttgatttttatctttattgtacttctcatccactttgagggctggaggatatctttttattggaatgtttcagtacatcgagttcttggtttcaaagaaatagacagacagacagaacagtttgaatatgcagcatatataattcatgcctataaagataaggattgggtctgggaacatttctcttcaatggaaaaggaagaccaatctctcaaattttgtctggaagaaagggactttgaggcgggtgtttttgaactagaagcaattgttaacagcatcaaaagaagcagaaaaattatttttgttataacacaccatctattaaaagacccattatgcaaaagattcaaggtacatcatgcagttcaacaagctattgaacaaaatctggattccattatattggttttccttgaggagattccagattataaactgaaccatgcactctgtttgcgaagaggaatgtttaaatctcactgcatcttgaactggccagttcagaaagaacggataggtgcctttcgtcataaattgcaagtagcacttggatccaaaaactctgtacattaaatttatttaaatattc

SEQ ID NO: 31774 - DNA, 2711 bp, Homo sapiens
cactttcgagagtgccgtctatttgccacacacttccctgatgaaatgtctggatttggactaaagaaaaaaggaaaggctagcagtcatccaacagaatcatgagacagactttgccttgtatctacttttgggggggccttttgccctttgggatgctgtgtgcatcctccaccaccaagtgcactgttagccatgaagttgctgactgcagccacctgaagttgactcaggtacccgatgatctacccacaaacataacagtgttgaaccttacccataatcaactcagaagattaccagccgccaacttcacaaggtatagccagctaactagcttggatgtaggatttaacaccatctcaaaactggagccagaattgtgccagaaacttcccatgttaaaagttttgaacctccagcacaatgagctatctcaactttctgataaaacctttgccttctgcacgaatttgactgaactccatctcatgtccaactcaatccagaaaattaaaaataatccctttgtcaagcagaagaatttaatcacattagatctgtctcataatggcttgtcatctacaaaattaggaactcaggttcagctggaaaatctccaagagcttctattatcaaacaataaaattcaagcgctaaaaagtgaagaactggatatctttgccaattcatctttaaaaaaattagagttgtcatcgaatcaaattaaagagttttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtggttggtaacgattcctttgcttggcttccacaactagaatatttcttcctagagtataataatatacagcatttgttttctcactctttgcacgggcttttcaatgtgaggtacctgaatttgaaacggtcttttactaaacaaagtatttcccttgcctcactccccaagattgatgatttttcttttcagtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaagaataaaatctcaaaaatagagagtgatgctttctcttggttgggccacctagaagtacttgacctgggccttaatgaaattgggcaagaactcacaggccaggaatggagaggtctagaaaatattttcgaaatctatctttcctacaacaagtacctgcagctgactaggaactcctttgccttggtcccaagccttcaacgactgatgctccgaagggtggcccttaaaaatgtggatagctctccttcaccattccagcctcttcgtaacttgaccattctggatctaagcaacaacaacatagccaacataaatgatgacatgttggagggtcttgagaaactagaaattctcgatttgcagcataacaacttagcacggctctggaaacacgcaaaccctggtggtcccatttatttcctaaagggtctgtctcacctccacatccttaacttggagtccaacggctttgacgagatcccagttgaggtcttcaaggatttatttgaactaaagatcatcgatttaggattgaataatttaaacacacttccagcatctgtctttaataatcaggtgtctctaaagtcattgaaccttcagaagaatctcataacatccgttgagaagaaggttttcgggccagctttcaggaacctgactgagttagatatgcgctttaatccctttgattgcacgtgtgaaagtattgcctggtttgttaattggattaacgagacccataccaacatccctgagctgtcaagccactacctttgcaacactccacctcactatcatgggttcccagtgagactttttgatacatcatcttgcaaagacagtgccccctttgaactctttttcatgatcaataccagtatcctgttgatttttatctttattgtacttctcatccactttgagggctggaggatatctttttattggaatgtttcagtacatcgagttcttggtttcaaagaaatagacagacagacagaacagtttgaatatgcagcatatataattcatgcctataaagataaggattgggtctgggaacatttctcttcaatggaaaaggaagaccaatctctcaaattttgtctggaagaaagggactttgaggcgggtgtttttgaactagaagcaattgttaacagcatcaaaagaagcagaaaaattatttttgttataacacaccatctattaaaagacccattatgcaaaagattcaaggtacatcatgcagttcaacaagctattgaacaaaatctggattccattatattggttttccttgaggagattccagattataaactgaaccatgcactctgtttgcgaagagcaaag

SEQ ID NO: 31775 - DNA, 2938 bp, Homo sapiens
agaatttggactcatatcaagatgctctgaagaagaacaaccctttaggatagccactgcaacatcatgaccaaagacaaagaacctattgttaaaagcttccattttgtttgccttatgatcataatagttggaaccagaatccagttctccgacggaaatgaatttgcagtagacaagtcaaaaagaggtcttattcatgttccaaaagacctaccgctgaaaaccaaagtcttagatatgtctcagaactacatcgctgagcttcaggtctctgacatgagctttctatcagagttgacagttttgagactttcccataacagaatccagctacttgatttaagtgttttcaagttcaaccaggatttagaatatttggatttatctcataatcagttgcaaaagatatcctgccatcctattgtgagtttcaggcatttagatctctcattcaatgatttcaaggccctgcccatctgtaaggaatttggcaacttatcacaactgaatttcttgggattgagtgctatgaagctgcaaaaattagatttgctgccaattgctcacttgcatctaagttatatccttctggatttaagaaattattatataaaagaaaatgagacagaaagtctacaaattctgaatgcaaaaacccttcaccttgtttttcacccaactagtttattcgctatccaagtgaacatatcagttaatactttagggtgcttacaactgactaatattaaattgaatgatgacaactgtcaagttttcattaaatttttatcagaactcaccagaggttcaaccttactgaattttaccctcaaccacatagaaacgacttggaaatgcctggtcagagtctttcaatttctttggcccaaacctgtggaatatctcaatatttacaatttaacaataattgaaagcattcgtgaagaagattttacttattctaaaacgacattgaaagcattgacaatagaacatatcacgaaccaagtttttctgttttcacagacagctttgtacaccgtgttttctgagatgaacattatgatgttaaccatttcagatacaccttttatacacatgctgtgtcctcatgcaccaagcacattcaagtttttgaactttacccagaacgttttcacagatagtatttttgaaaaatgttccacgttagttaaattggagacacttatcttacaaaagaatggattaaaagaccttttcaaagtaggtctcatgacgaaggatatgccttctttggaaatactggatgttagctggaattctttggaatctggtagacataaagaaaactgcacttgggttgagagtatagtggtgttaaatttgtcttcaaatatgcttactgactctgttttcagatgtttacctcccaggatcaaggtacttgatcttcacagcaataaaataaagagcgttcctaaacaagtcgtaaaactggaagctttgcaagaactcaatgttgctttcaattctttaactgaccttcctggatgtggcagctttagcagcctttctgtattgatcattgatcacaattcagtttcccacccatcggctgatttcttccagagctgccagaagatgaggtcaataaaagcaggggacaatccattccaatgtacctgtgagctaagagaatttgtcaaaaatatagaccaagtatcaagtgaagtgttagagggctggcctgattcttataagtgtgactacccagaaagttatagaggaagcccactaaaggactttcacatgtctgaattatcctgcaacataactctgctgatcgtcaccatcggtgccaccatgctggtgttggctgtgactgtgacctccctctgcatctacttggatctgccctggtatctcaggatggtgtgccagtggacccagactcggcgcagggccaggaacatacccttagaagaactccaaagaaacctccagtttcatgcttttatttcatatagtgaacatgattctgcctgggtgaaaagtgaattggtaccttacctagaaaaagaagatatacagatttgtcttcatgagagaaactttgtccctggcaagagcattgtggaaaatatcatcaactgcattgagaagagttacaagtccatctttgttttgtctcccaactttgtccagagtgagtggtgccattacgaactctattttgcccatcacaatctctttcatgaaggatctaataacttaatcctcatcttactggaacccattccacagaacagcattcccaacaagtaccacaagctgaaggctctcatgacgcagcggacttatttgcagtggcccaaggagaaaagcaaacgtgggctcttttgggctaacattagagccgcttttaatatgaaattaacactagtcactgaaaacaatgatgtgaaatcttaaaaaaatttaggaaattcaacttaagaaaccattatttacttggatgatggtgaatagtacagtcgtaagtaactgtctggaggtgcctccattatcctcatgccttcaggaaagacttaacaaaaacaatgtttcatctggggaactgagctaggcggtgaggttagcctgccagttagagacagcccagtctcttctggtttaatcattatgtttcaaattgaaacagtctcttttgagtaaatgctcagtttttcagctcctctccactctgctttcccaaatggattctgttgtgagcaagagtttatatggcttcatggcagcaagggaacagtcaacttcagcatcatatgcaccagtcctcggagtgccctgtgaatcatattggtctttgggtcagtgtcatcattctcttcaagtctggggcttggggaaaaaattagatcagctacggcatataaaaaagtcttttgtttca

SEQ ID NO: 31776 - DNA, 5879 bp, Homo sapiens
attgtatttccgttcatttacaagttattttctcttcttctgaaaaagagatcttgaatttggactcatatcaagatgctctgaagaagaacaaccctttaggatagccactgcaacatcatgaccaaagacaaagaacctattgttaaaagcttccattttgtttgccttatgatcataatagttggaaccagaatccagttctccgacggaaatgaatttgcagtagacaagtcaaaaagaggtcttattcatgttccaaaagacctaccgctgaaaaccaaagtcttagatatgtctcagaactacatcgctgagcttcaggtctctgacatgagctttctatcagagttgacagttttgagactttcccataacagaatccagctacttgatttaagtgttttcaagttcaaccaggatttagaatatttggatttatctcataatcagttgcaaaagatatcctgccatcctattgtgagtttcaggcatttagatctctcattcaatgatttcaaggccctgcccatctgtaaggaatttggcaacttatcacaactgaatttcttgggattgagtgctatgaagctgcaaaaattagatttgctgccaattgctcacttgcatctaagttatatccttctggatttaagaaattattatataaaagaaaatgagacagaaagtctacaaattctgaatgcaaaaacccttcaccttgtttttcacccaactagtttattcgctatccaagtgaacatatcagttaatactttagggtgcttacaactgactaatattaaattgaatgatgacaactgtcaagttttcattaaatttttatcagaactcaccagaggttcaaccttactgaattttaccctcaaccacatagaaacgacttggaaatgcctggtcagagtctttcaatttctttggcccaaacctgtggaatatctcaatatttacaatttaacaataattgaaagcattcgtgaagaagattttacttattctaaaacgacattgaaagcattgacaatagaacatatcacgaaccaagtttttctgttttcacagacagctttgtacaccgtgttttctgagatgaacattatgatgttaaccatttcagatacaccttttatacacatgctgtgtcctcatgcaccaagcacattcaagtttttgaactttacccagaacgttttcacagatagtatttttgaaaaatgttccacgttagttaaattggagacacttatcttacaaaagaatggattaaaagaccttttcaaagtaggtctcatgacgaaggatatgccttctttggaaatactggatgttagctggaattctttggaatctggtagacataaagaaaactgcacttgggttgagagtatagtggtgttaaatttgtcttcaaatatgcttactgactctgttttcagatgtttacctcccaggatcaaggtacttgatcttcacagcaataaaataaagagcgttcctaaacaagtcgtaaaactggaagctttgcaagaactcaatgttgctttcaattctttaactgaccttcctggatgtggcagctttagcagcctttctgtattgatcattgatcacaattcagtttcccacccatcggctgatttcttccagagctgccagaagatgaggtcaataaaagcaggggacaatccattccaatgtacctgtgagctaagagaatttgtcaaaaatatagaccaagtatcaagtgaagtgttagagggctggcctgattcttataagtgtgactacccagaaagttatagaggaagcccactaaaggactttcacatgtctgaattatcctgcaacataactctgctgatcgtcaccatcggtgccaccatgctggtgttggctgtgactgtgacctccctctgcatctacttggatctgccctggtatctcaggatggtgtgccagtggacccagactcggcgcagggccaggaacatacccttagaagaactccaaagaaacctccagtttcatgcttttatttcatatagtgaacatgattctgcctgggtgaaaagtgaattggtaccttacctagaaaaagaagatatacagatttgtcttcatgagagaaactttgtccctggcaagagcattgtggaaaatatcatcaactgcattgagaagagttacaagtccatctttgttttgtctcccaactttgtccagagtgagtggtgccattacgaactctattttgcccatcacaatctctttcatgaaggatctaataacttaatcctcatcttactggaacccattccacagaacagcattcccaacaagtaccacaagctgaaggctctcatgacgcagcggacttatttgcagtggcccaaggagaaaagcaaacgtgggctcttttgggctaacattagagccgcttttaatatgaaattaacactagtcactgaaaacaatgatgtgaaatcttaaaaaaatttaggaaattcaacttaagaaaccattatttacttggatgatggtgaatagtacagtcgtaagtaactgtctggaggtgcctccattatcctcatgccttcaggaaagacttaacaaaaacaatgtttcatctggggaactgagctaggcggtgaggttagcctgccagttagagacagcccagtctcttctggtttaatcattatgtttcaaattgaaacagtctcttttgagtaaatgctcagtttttcagctcctctccactctgctttcccaaatggattctgttgtgagcaagagtttatatggcttcatggcagcaagggaacagtcaacttcagcatcatatgcaccagtcctcggagtgccctgtgaatcatattggtctttgggtcagtgtcatcattctcttcaagtctggggcttggggaaaaaattagatcagctacggcatataaaaaagtcttttgtttcacatatgtgtaatagcttatttaattttttatcctgctacacaaatatgtaattaaccaatgaggactcatgacttgatagtgtatgtatgtaaagggatatatggacttaatcataagctgttgaggtgaaagacgtggatccacctgctttccaagaaaactcggccaaatttatttgcagctggatattgaatgggacttttctggttgtcttagaattctggctaaaggctcaaagctgacgaaagacagtaactgcaccaacatgatactagacacagccagtctggacttatcaaaagagcagaaagagaccaatgactcccagtccgtattatccatctctagaagactagagtcaaaagcgtgattaaagagtcattaagcggaggttctaggccatagggagattgctttgaatttcttgcagacaagtgtgagggactcagcatggtagaaggtagcctggcatcccactccaagactgaaagcttgcagagtaacaggagcacacaggttcagtgcagcagatgtggtgtggcttgagaattcttggaagagcttgatgagtgtttgctggagtccgagggtgggcactgggaacacagagactggtaaatagtgtttggcaaatacaagtgcttgatgaatatttgttgaatgaatagatgagttcttcccccctggggaattcaggaggtgaaaggttggcttgagcacccaaaatggcaggatgagagaagagaagcactgatagcaacctgccctcccattattgacatggtaaaaggatgtgaatttcttcacatggctttgactatggaagagtagctgggcttgcattgtcatgacgggatatcagccaacagggtagcctgttgtgcaaagaaactatagcagtaagaggacacggggttaggcagaagaggggtttggggtggaggttgctgcaagaggtcagccagataatgtggccctgcatcatggaactgtgcaatgtggggtacactcaaggccctccaataactcacagatgtgccctatgaaaaagccagcatttggactctgccatagcagctggcaggatcatgctggcctgtctgccttattcaatagttaactacaggaagatctgctcctctttgtgtaataccctcttcccttgcaatggcatagggacatctagaatatagagaagacagagacaatggaggaagagtaaagaaactgactatatgccttcgtcatttcactgcaaggaaggccaagcagatttttgaatgaggtgtgagattgctgttaaattggactggcctggacattttaatcccttaaatagaggtgcaatgactaaagtgagatttgtcactaaaatttatggtatctgcccaagattcaggagtgatgatgggaggagatccaacagaactttgttgtaaggcaatggttagagaaaaatgaagccctcgctttctggacttagttcattcaataaaccagtttcggccaggcacgttggctcacatctataatcccagtactgtgggaggctgaggcaggtggatcacttgaggtcaggagttcgagaccagcctggccaacatggtgaaaccctgtctgtactaaaaatacaaaaattagccgggtgtggtggtgtgcacctgtagtcccagctactcgggaggctgaggcaggaaaatcacttgaacctgggagacagaggctgtagtgagctgagacagcgctactgtactccccgctgggcaacagagtgagactccatctcaaaaaagttaaaagaaaaaaaatctggtttcataatagctgtaacgaaataagccttaatgatattttattagcatcatcttctgtctgcattagcccttccttgctcttcaggagaacaacatttgttttcctccctaggctctatcccaaacggcacattcttccacaacccctgttgaacagattttttaaactgttgcctaatctaaaaacaataaaaacaacaaacaaccacagtaacaacaacgacaaaaaaaactgccacagattctaaataatcagatctttttaaatggtatcaatgtttcccacaaaatattgttgacattgaaaatatagaattttagcattaattttgttaaacctacatcccctcggcagaggggcctccctgcatcccagtggaaagtaggttcctcacagtcctctccgtcacattcttcccatttcttttcttcacagaacacatcactgtctaaaattatcttgtttgcttagttgcttactcatcttcttcttctctcctctgaagtctaagctccaggaaaaagggagacttctccacctgttccctgcctctccccagtgccgaggggacactgtgcaccccattgtagatgcgcagtaaaaactcgtgggatgagcaaatgactctgaaacggtcccatgcgggaaatgtccatgaagtcctggattttatctaaaaagcccaggcaggggggggcgggggcggcggggctacagttccacgctgagctgcctcctggccgctcgtccccgccgcagtgcctgggcggcccgggcgcccgaccttggccgtggacaccttcgcggtgggtgctgctcctccccatctgccactggaagatgctggggcgacccggctccaggtttagcaggacactgagaaaagggaatggctgcctttcggaggctgggtgagcccttctctgtgcctcacctgcccgccccacagcggccctgcacctcgtcccacggggcccattgccccggtaggatgcgcgcttttgttttgagggtcaggcatcttccctgccgtcgtttctgggaggttgaaaaattgatccagaaagacct

SEQ ID NO: 31777 - DNA, 572 bp, Homo sapiens
aattgtatttccgttcatttacaagttattttctcttcttctgaaaaagagatcttgaatttggactcatatcaagatgctctgaagaagaacaaccctttaggatagccactgcaacatcatgaccaaagacaaagaacctattgttaaaagcttccattttgtttgccttatgatcataatagttggaaccagaatccagttctccgacggaaatgaatttgcagtagacaagtcaaaaagaggtcttattcatgttccaaaagacctaccgctgaaaaccaaagtcttagatatgtctcagaactacatcgctgagcttcaggtctctgacatgagctttctatcagagttgacagttttgagactttcccataacagaatccagctacttgatttaagtgttttcaagttcaaccaggatttagaatatttggatttatctcataatcagttgcaaaagatatcctgccatcctattgtgagtttcaggcatttagatctctcattcaatgatttcaaggccctgcccatctgtaaggaatttggcaacttatcacaactgaatttct

SEQ ID NO: 31778 - DNA, 1628 bp, Homo sapiens
ccctttaggatagccactgcaacatcatgaccaaagacaaagaacctattgttaaaagcttccattttgtttgccttatgatcataatagttggaaccagaatccagttctccgacggaaatgaatttgcagtagacaagtcaaaaagaggtcttattcatgttccaaaagacctaccgctgaaaaccaaagtcttagatatgtctcagaactacatcgctgagcttcaggtctctgacatgagctttctatcagagttgacagttttgagactttcccataacagaatccagctacttgatttaagtgttttcaagttcaaccaggatttagaatatttggatttatctcataatcagttgcaaaagatatcctgccatcctattgtgagtttcaggcatttagatctctcattcaatgatttcaaggccctgcccatctgtaaggaatttggcaacttatcacaactgaatttcttgggattgagtgctatgaagctgcaaaaattagatttgctgccaattgctcacttgcatctaagttatatccttctggatttaagaaattattatataaaagaaaatgagacagaaagtctacaaattctgaatgcaaaaacccttcaccttgtttttcacccaactagtttattcgctatccaagtgaacatatcagttaatactttagggtgcttacaactgactaatattaaattgaatgatgacaactgtcaagttttcattaaatttttatcagaactcaccagaggttcaaccttactgaattttaccctcaaccacatagaaacgacttggaaatgcctggtcagagtctttcaatttctttggcccaaacctgtggaatatctcaatatttacaatttaacaataattgaaagcattcgtgaagaagattttacttattctaaaacgacattgaaagcattgacaatagaacatatcacgaaccaagtttttctgttttcacagacagctttgtacaccgtgttttctgagatgaacattatgatgttaaccatttcagatacaccttttatacacatgctgtgtcctcatgcaccaagcacattcaagtttttgaactttacccagaacgttttcacagatagtatttttgaaaaatgttccacgttagttaaattggagacacttatctttgttttgtctcccaactttgtccagagtgagtggtgccattacgaactctattttgcccatcacaatctctttcatgaaggatctaataacttaatcctcatcttactggaacccattccacagaacagcattcccaacaagtaccacaagctgaaggctctcatgacgcagcggacttatttgcagtggcccaaggagaaaagcaaacgtgggctcttttgggctaacattagagccgcttttaatatgaaattaacactagtcactgaaaacaatgatgtgaaatcttaaaaaaatttaggaaattcaacttaagaaaccattatttacttggatgatggtgaatagtacagtcgtaagtaactgtctggaggtgcctccattatcctcatgccttcaggaaagacttaacaaaaacaatgtttcatctggggaactgagctaggcggt

SEQ ID NO: 31779 - DNA, 548 bp, Homo sapiens
aattgtatttccgttcatttacaagttattttctcttcttctgaaaaagagatcttgtggccaagtggatttttcaaatgtatgtgtgtctctgtgggtgttctgatgggcagttgggagaagttatatggatcagtgaagagcttttaaccatacgccattcagtaataaaagttccccaactcagagttttcactcttccaaagaaagaatttggactcatatcaagatgctctgaagaagaacaaccctttaggatagccactgcaacatcatgaccaaagacaaagaacctattgttaaaagcttccattttgtttgccttatgatcataatagttggaaccagaatccagttctccgacggaaatgaatttgcagtagacaagtcaaaaagaggtcttattcatgttccaaaagacctaccgctgaaaaccaaagtcttagatatgtctcagaactacatcgctgagcttcaggtctctgacatgagctttctatcagagttgacagttttgagactttcccataacagaatccagctacttg

SEQ ID NO: 31780 - DNA, 5011 bp, Homo sapiens
gaagactccagatataggatcactccatgccatcaagaaagttgatgctattgggcccatctcaagctgatcttggcacctctcatgctctgctctcttcaaccagacctctacattccattttggaagaagactaaaaatggtgtttccaatgtggacactgaagagacaaattcttatcctttttaacataatcctaatttccaaactccttggggctagatggtttcctaaaactctgccctgtgatgtcactctggatgttccaaagaaccatgtgatcgtggactgcacagacaagcatttgacagaaattcctggaggtattcccacgaacaccacgaacctcaccctcaccattaaccacataccagacatctccccagcgtcctttcacagactggaccatctggtagagatcgatttcagatgcaactgtgtacctattccactggggtcaaaaaacaacatgtgcatcaagaggctgcagattaaacccagaagctttagtggactcacttatttaaaatccctttacctggatggaaaccagctactagagataccgcagggcctcccgcctagcttacagcttctcagccttgaggccaacaacatcttttccatcagaaaagagaatctaacagaactggccaacatagaaatactctacctgggccaaaactgttattatcgaaatccttgttatgtttcatattcaatagagaaagatgccttcctaaacttgacaaagttaaaagtgctctccctgaaagataacaatgtcacagccgtccctactgttttgccatctactttaacagaactatatctctacaacaacatgattgcaaaaatccaagaagatgattttaataacctcaaccaattacaaattcttgacctaagtggaaattgccctcgttgttataatgccccatttccttgtgcgccgtgtaaaaataattctcccctacagatccctgtaaatgcttttgatgcgctgacagaattaaaagttttacgtctacacagtaactctcttcagcatgtgcccccaagatggtttaagaacatcaacaaactccaggaactggatctgtcccaaaacttcttggccaaagaaattggggatgctaaatttctgcattttctccccagcctcatccaattggatctgtctttcaattttgaacttcaggtctatcgtgcatctatgaatctatcacaagcattttcttcactgaaaagcctgaaaattctgcggatcagaggatatgtctttaaagagttgaaaagctttaacctctcgccattacataatcttcaaaatcttgaagttcttgatcttggcactaactttataaaaattgctaacctcagcatgtttaaacaatttaaaagactgaaagtcatagatctttcagtgaataaaatatcaccttcaggagattcaagtgaagttggcttctgctcaaatgccagaacttctgtagaaagttatgaaccccaggtcctggaacaattacattatttcagatatgataagtatgcaaggagttgcagattcaaaaacaaagaggcttctttcatgtctgttaatgaaagctgctacaagtatgggcagaccttggatctaagtaaaaatagtatattttttgtcaagtcctctgattttcagcatctttctttcctcaaatgcctgaatctgtcaggaaatctcattagccaaactcttaatggcagtgaattccaacctttagcagagctgagatatttggacttctccaacaaccggcttgatttactccattcaacagcatttgaagagcttcacaaactggaagttctggatataagcagtaatagccattattttcaatcagaaggaattactcatatgctaaactttaccaagaacctaaaggttctgcagaaactgatgatgaacgacaatgacatctcttcctccaccagcaggaccatggagagtgagtctcttagaactctggaattcagaggaaatcacttagatgttttatggagagaaggtgataacagatacttacaattattcaagaatctgctaaaattagaggaattagacatctctaaaaattccctaagtttcttgccttctggagtttttgatggtatgcctccaaatctaaagaatctctctttggccaaaaatgggctcaaatctttcagttggaagaaactccagtgtctaaagaacctggaaactttggacctcagccacaaccaactgaccactgtccctgagagattatccaactgttccagaagcctcaagaatctgattcttaagaataatcaaatcaggagtctgacgaagtattttctacaagatgccttccagttgcgatatctggatctcagctcaaataaaatccagatgatccaaaagaccagcttcccagaaaatgtcctcaacaatctgaagatgttgcttttgcatcataatcggtttctgtgcacctgtgatgctgtgtggtttgtctggtgggttaaccatacggaggtgactattccttacctggccacagatgtgacttgtgtggggccaggagcacacaagggccaaagtgtgatctccctggatctgtacacctgtgagttagatctgactaacctgattctgttctcactttccatatctgtatctctctttctcatggtgatgatgacagcaagtcacctctatttctgggatgtgtggtatatttaccatttctgtaaggccaagataaaggggtatcagcgtctaatatcaccagactgttgctatgatgcttttattgtgtatgacactaaagacccagctgtgaccgagtgggttttggctgagctggtggccaaactggaagacccaagagagaaacattttaatttatgtctcgaggaaagggactggttaccagggcagccagttctggaaaacctttcccagagcatacagcttagcaaaaagacagtgtttgtgatgacagacaagtatgcaaagactgaaaattttaagatagcattttacttgtcccatcagaggctcatggatgaaaaagttgatgtgattatcttgatatttcttgagaagccctttcagaagtccaagttcctccagctccggaaaaggctctgtgggagttctgtccttgagtggccaacaaacccgcaagctcacccatacttctggcagtgtctaaagaacgccctggccacagacaatcatgtggcctatagtcaggtgttcaaggaaacggtctagcccttctttgcaaaacacaactgcctagtttaccaaggagaggcctggctgtttaaattgttttcatatatatcacaccaaaagcgtgttttgaaattcttcaagaaatgagattgcccatatttcaggggagccaccaacgtctgtcacaggagttggaaagatggggtttatataatgcatcaagtcttctttcttatctctctgtgtctctatttgcacttgagtctctcacctcagctcctgtaaaagagtggcaagtaaaaaacatggggctctgattctcctgtaattgtgataattaaatatacacacaatcatgacattgagaagaactgcatttctacccttaaaaagtactggtatatacagaaatagggttaaaaaaaactcaagctctctctatatgagaccaaaatgtactagagttagtttagtgaaataaaaaaccagtcagctggccgggcatggtggctcatgcttgtaatcccagcactttgggaggccgaggcaggtggatcacgaggtcaggagtttgagaccagtctggccaacatggtgaaaccccgtctgtactaaaaatacaaaaattagctgggcgtggtggtgggtgcctgtaatcccagctacttgggaggctgaggcaggagaatcgcttgaacccgggaggtggaggtggcagtgagccgagatcacgccactgcaatgcagcccgggcaacagagctagactgtctcaaaagaacaaaaaaaaaaaaacacaaaaaaactcagtcagcttcttaaccaattgcttccgtgtcatccagggccccattctgtgcagattgagtgtgggcaccacacaggtggttgctgcttcagtgcttcctgctctttttccttgggcctgcttctgggttccatagggaaacagtaagaaagaaagacacatccttaccataaatgcatatggtccacctacaaatagaaaaatatttaaatgatctgcctttatacaaagtgatattctctacctttgataatttacctgcttaaatgtttttatctgcactgcaaagtactgtatccaaagtaaaatttcctcatccaatatctttcaaactgttttgttaactaatgccatatatttgtaagtatctgcacacttgatacagcaacgttagatggttttgatggtaaaccctaaaggaggactccaagagtgtgtatttatttatagttttatcagagatgacaattatttgaatgccaattatatggattcctttcattttttgctggaggatgggagaagaaaccaaagtttatagaccttcacattgagaaagcttcagttttgaacttcagctatcagattcaaaaacaacagaaagaaccaagacattcttaagatgcctgtactttcagctgggtataaattcatgagttcaaagattgaaacctgaccaatttgctttatttcatggaagaagtgatctacaaaggtgtttgtgccatttggaaaacagcgtgcatgtgttcaagccttagattggcgatgtcgtattttcctcacgtgtggcaatgccaaaggctttactttacctgtgagtacacactatatgaattatttccaacgtacatttaatcaataagggtcacaaattcccaaatcaatctctggaataaatagagaggtaattaaattgctggagccaactatttcacaacttctgtaagc

SEQ ID NO: 31781 - DNA, 4216 bp, Homo sapiens
agtttctcttctcggccacctcctgcatagagggtaccattctgcgctgctgcaagttacggaatgaaaaattagaacaacagaaacatggaaaacatgttccttcagtcgtcaatgctgacctgcattttcctgctaatatctggttcctgtgagttatgcgccgaagaaaatttttctagaagctatccttgtgatgagaaaaagcaaaatgactcagttattgcagagtgcagcaatcgtcgactacaggaagttccccaaacggtgggcaaatatgtgacagaactagacctgtctgataatttcatcacacacataacgaatgaatcatttcaagggctgcaaaatctcactaaaataaatctaaaccacaaccccaatgtacagcaccagaacggaaatcccggtatacaatcaaatggcttgaatatcacagacggggcattcctcaacctaaaaaacctaagggagttactgcttgaagacaaccagttaccccaaataccctctggtttgccagagtctttgacagaacttagtctaattcaaaacaatatatacaacataactaaagagggcatttcaagacttataaacttgaaaaatctctatttggcctggaactgctattttaacaaagtttgcgagaaaactaacatagaagatggagtatttgaaacgctgacaaatttggagttgctatcactatctttcaattctctttcacacgtgccacccaaactgccaagctccctacgcaaactttttctgagcaacacccagatcaaatacattagtgaagaagatttcaagggattgataaatttaacattactagatttaagcgggaactgtccgaggtgcttcaatgccccatttccatgcgtgccttgtgatggtggtgcttcaattaatatagatcgttttgcttttcaaaacttgacccaacttcgatacctaaacctctctagcacttccctcaggaagattaatgctgcctggtttaaaaatatgcctcatctgaaggtgctggatcttgaattcaactatttagtgggagaaatagcctctggggcatttttaacgatgctgccccgcttagaaatacttgacttgtcttttaactatataaaggggagttatccacagcatattaatatttccagaaacttctctaaacttttgtctctacgggcattgcatttaagaggttatgtgttccaggaactcagagaagatgatttccagcccctgatgcagcttccaaacttatcgactatcaacttgggtattaattttattaagcaaatcgatttcaaacttttccaaaatttctccaatctggaaattatttacttgtcagaaaacagaatatcaccgttggtaaaagatacccggcagagttatgcaaatagttcctcttttcaacgtcatatccggaaacgacgctcaacagattttgagtttgacccacattcgaacttttatcatttcacccgtcctttaataaagccacaatgtgctgcttatggaaaagccttagatttaagcctcaacagtattttcttcattgggccaaaccaatttgaaaatcttcctgacattgcctgtttaaatctgtctgcaaatagcaatgctcaagtgttaagtggaactgaattttcagccattcctcatgtcaaatatttggatttgacaaacaatagactagactttgataatgctagtgctcttactgaattgtccgacttggaagttctagatctcagctataattcacactatttcagaatagcaggcgtaacacatcatctagaatttattcaaaatttcacaaatctaaaagttttaaacttgagccacaacaacatttatactttaacagataagtataacctggaaagcaagtccctggtagaattagttttcagtggcaatcgccttgacattttgtggaatgatgatgacaacaggtatatctccattttcaaaggtctcaagaatctgacacgtctggatttatcccttaataggctgaagcacatcccaaatgaagcattccttaatttgccagcgagtctcactgaactacatataaatgataatatgttaaagttttttaactggacattactccagcagtttcctcgtctcgagttgcttgacttacgtggaaacaaactactctttttaactgatagcctatctgactttacatcttcccttcggacactgctgctgagtcataacaggatttcccacctaccctctggctttctttctgaagtcagtagtctgaagcacctcgatttaagttccaatctgctaaaaacaatcaacaaatccgcacttgaaactaagaccaccaccaaattatctatgttggaactacacggaaacccctttgaatgcacctgtgacattggagatttccgaagatggatggatgaacatctgaatgtcaaaattcccagactggtagatgtcatttgtgccagtcctggggatcaaagagggaagagtattgtgagtctggagctaacaacttgtgtttcagatgtcactgcagtgatattatttttcttcacgttctttatcaccaccatggttatgttggctgccctggctcaccatttgttttactgggatgtttggtttatatataatgtgtgtttagctaaggtaaaaggctacaggtctctttccacatcccaaactttctatgatgcttacatttcttatgacaccaaagatgcctctgttactgactgggtgataaatgagctgcgctaccaccttgaagagagccgagacaaaaacgttctcctttgtctagaggagagggattgggatccgggattggccatcatcgacaacctcatgcagagcatcaaccaaagcaagaaaacagtatttgttttaaccaaaaaatatgcaaaaagctggaactttaaaacagctttttacttggctttgcagaggctaatggatgagaacatggatgtgattatatttatcctgctggagccagtgttacagcattctcagtatttgaggctacggcagcggatctgtaagagctccatcctccagtggcctgacaacccgaaggcagaaggcttgttttggcaaactctgagaaatgtggtcttgactgaaaatgattcacggtataacaatatgtatgtcgattccattaagcaatactaactgacgttaagtcatgatttcgcgccataataaagatgcaaaggaatgacatttctgtattagttatctattgctatgtaacaaattatcccaaaacttagtggtttaaaacaacacatttgctggcccacagtttttgagggtcaggagtccaggcccagcataactgggtcctctgctcagggtgtctcagaggctgcaatgtaggtgttcaccagagacataggcatcactggggtcacactcatgtggttgttttctggattcaattcctcctgggctattggccaaaggctatactcatgtaagccatgcgagcctctcccacaaggcagcttgcttcatcagagctagcaaaaaagagaggttgctagcaagatgaagtcacaatcttttgtaatcgaatcaaaaaagtgatatctcatcactttggccatattctatttgttagaagtaaaccacaggtcccaccagctccatgggagtgaccacctcagtccagggaaaacagctgaagaccaagatggtgagctctgattgcttcagttggtcatcaactattttcccttgactgctgtcctgggatggcctgctatcttgatgatagattgtgaatatcaggaggcagggatcactgtggaccatcttagcagttgacctaacacatcttcttttcaatatctaagaacttttgccactgtgactaatggtcctaatattaagctgttgtttatatttatcatatatctatggctacatggttatattatgctgtggttgcgttcggttttatttacagttgcttttacaaatatttgctgtaacatttgacttctaaggtttagatgccatttaagaactgagatggatagcttttaaagcatcttttacttcttaccattttttaaaagtatgcagctaaattcgaagcttttggtctatattgttaattgccattgctgtaaatcttaaaatgaatgaataaaaatgtttcattttacaa

SEQ ID NO: 31782 - DNA, 3367 bp, Homo sapiens
ctcctgcatagagggtaccattctgcgctgctgcaagttacggaatgaaaaattagaacaacagaaacatggttctcttgacacttcagtgttagggaacatcagcaagacccatcccaggagaccttgaaggaagcctttgaaagggagaatgaaggagtcatctttgcaaaatagctcctgcagcctgggaaaggagactaaaaaggaaaacatgttccttcagtcgtcaatgctgacctgcattttcctgctaatatctggttcctgtgagttatgcgccgaagaaaatttttctagaagctatccttgtgatgagaaaaagcaaaatgactcagttattgcagagtgcagcaatcgtcgactacaggaagttccccaaacggtgggcaaatatgtgacagaactagacctgtctgataatttcatcacacacataacgaatgaatcatttcaagggctgcaaaatctcactaaaataaatctaaaccacaaccccaatgtacagcaccagaacggaaatcccggtatacaatcaaatggcttgaatatcacagacggggcattcctcaacctaaaaaacctaagggagttactgcttgaagacaaccagttaccccaaataccctctggtttgccagagtctttgacagaacttagtctaattcaaaacaatatatacaacataactaaagagggcatttcaagacttataaacttgaaaaatctctatttggcctggaactgctattttaacaaagtttgcgagaaaactaacatagaagatggagtatttgaaacgctgacaaatttggagttgctatcactatctttcaattctctttcacacgtgccacccaaactgccaagctccctacgcaaactttttctgagcaacacccagatcaaatacattagtgaagaagatttcaagggattgataaatttaacattactagatttaagcgggaactgtccgaggtgcttcaatgccccatttccatgcgtgccttgtgatggtggtgcttcaattaatatagatcgttttgcttttcaaaacttgacccaacttcgatacctaaacctctctagcacttccctcaggaagattaatgctgcctggtttaaaaatatgcctcatctgaaggtgctggatcttgaattcaactatttagtgggagaaatagcctctggggcatttttaacgatgctgccccgcttagaaatacttgacttgtcttttaactatataaaggggagttatccacagcatattaatatttccagaaacttctctaaacttttgtctctacgggcattgcatttaagaggttatgtgttccaggaactcagagaagatgatttccagcccctgatgcagcttccaaacttatcgactatcaacttgggtattaattttattaagcaaatcgatttcaaacttttccaaaatttctccaatctggaaattatttacttgtcagaaaacagaatatcaccgttggtaaaagatacccggcagagttatgcaaatagttcctcttttcaacgtcatatccggaaacgacgctcaacagattttgagtttgacccacattcgaacttttatcatttcacccgtcctttaataaagccacaatgtgctgcttatggaaaagccttagatttaagcctcaacagtattttcttcattgggccaaaccaatttgaaaatcttcctgacattgcctgtttaaatctgtctgcaaatagcaatgctcaagtgttaagtggaactgaattttcagccattcctcatgtcaaatatttggatttgacaaacaatagactagactttgataatgctagtgctcttactgaattgtccgacttggaagttctagatctcagctataattcacactatttcagaatagcaggcgtaacacatcatctagaatttattcaaaatttcacaaatctaaaagttttaaacttgagccacaacaacatttatactttaacagataagtataacctggaaagcaagtccctggtagaattagttttcagtggcaatcgccttgacattttgtggaatgatgatgacaacaggtatatctccattttcaaaggtctcaagaatctgacacgtctggatttatcccttaataggctgaagcacatcccaaatgaagcattccttaatttgccagcgagtctcactgaactacatataaatgataatatgttaaagttttttaactggacattactccagcagtttcctcgtctcgagttgcttgacttacgtggaaacaaactactctttttaactgatagcctatctgactttacatcttcccttcggacactgctgctgagtcataacaggatttcccacctaccctctggctttctttctgaagtcagtagtctgaagcacctcgatttaagttccaatctgctaaaaacaatcaacaaatccgcacttgaaactaagaccaccaccaaattatctatgttggaactacacggaaacccctttgaatgcacctgtgacattggagatttccgaagatggatggatgaacatctgaatgtcaaaattcccagactggtagatgtcatttgtgccagtcctggggatcaaagagggaagagtattgtgagtctggagctaacaacttgtgtttcagatgtcactgcagtgatattatttttcttcacgttctttatcaccaccatggttatgttggctgccctggctcaccatttgttttactgggatgtttggtttatatataatgtgtgtttagctaaggtaaaaggctacaggtctctttccacatcccaaactttctatgatgcttacatttcttatgacaccaaagatgcctctgttactgactgggtgataaatgagctgcgctaccaccttgaagagagccgagacaaaaacgttctcctttgtctagaggagagggattgggatccgggattggccatcatcgacaacctcatgcagagcatcaaccaaagcaagaaaacagtatttgttttaaccaaaaaatatgcaaaaagctggaactttaaaacagctttttacttggctttgcagaggctaatggatgagaacatggatgtgattatatttatcctgctggagccagtgttacagcattctcagtatttgaggctacggcagcggatctgtaagagctccatcctccagtggcctgacaacccgaaggcagaaggcttgttttggcaaactctgagaaatgtggtcttgactgaaaatgattcacggtataacaatatgtatgtcgattccattaagcaatactaactgacgttaagtcatgatttcgcgccataataaaga

SEQ ID NO: 31783 - DNA, 3870 bp, Homo sapiens
ggaggtcttgtttccggaagatgttgcaaggctgtggtgaaggcaggtgcagcctagcctcctgctcaagctacaccctggccctccacgcatgaggccctgcagaactctggagatggtgcctacaagggcagaaaaggacaagtcggcagccgctgtcctgagggcaccagctgtggtgcaggagccaagacctgagggtggaagtgtcctcttagaatggggagtgcccagcaaggtgtacccgctactggtgctatccagaattcccatctctccctgctctctgcctgagctctgggccttagctcctccctgggcttggtagaggacaggtgtgaggccctcatgggatgtaggctgtctgagaggggagtggaaagaggaaggggtgaaggagctgtctgccatttgactatgcaaatggcctttgactcatgggaccctgtcctcctcactgggggcagggtggagtggagggggagctactaggctggtataaaaatcttacttcctctattctctgagccgctgctgcccctgtgggaagggacctcgagtgtgaagcatccttccctgtagctgctgtccagtctgcccgccagaccctctggagaagcccctgccccccagcatgggtttctgccgcagcgccctgcacccgctgtctctcctggtgcaggccatcatgctggccatgaccctggccctgggtaccttgcctgccttcctaccctgtgagctccagccccacggcctggtgaactgcaactggctgttcctgaagtctgtgccccacttctccatggcagcaccccgtggcaatgtcaccagcctttccttgtcctccaaccgcatccaccacctccatgattctgactttgcccacctgcccagcctgcggcatctcaacctcaagtggaactgcccgccggttggcctcagccccatgcacttcccctgccacatgaccatcgagcccagcaccttcttggctgtgcccaccctggaagagctaaacctgagctacaacaacatcatgactgtgcctgcgctgcccaaatccctcatatccctgtccctcagccataccaacatcctgatgctagactctgccagcctcgccggcctgcatgccctgcgcttcctattcatggacggcaactgttattacaagaacccctgcaggcaggcactggaggtggccccgggtgccctccttggcctgggcaacctcacccacctgtcactcaagtacaacaacctcactgtggtgccccgcaacctgccttccagcctggagtatctgctgttgtcctacaaccgcatcgtcaaactggcgcctgaggacctggccaatctgaccgccctgcgtgtgctcgatgtgggcggaaattgccgccgctgcgaccacgctcccaacccctgcatggagtgccctcgtcacttcccccagctacatcccgataccttcagccacctgagccgtcttgaaggcctggtgttgaaggacagttctctctcctggctgaatgccagttggttccgtgggctgggaaacctccgagtgctggacctgagtgagaacttcctctacaaatgcatcactaaaaccaaggccttccagggcctaacacagctgcgcaagcttaacctgtccttcaattaccaaaagagggtgtcctttgcccacctgtctctggccccttccttcgggagcctggtcgccctgaaggagctggacatgcacggcatcttcttccgctcactcgatgagaccacgctccggccactggcccgcctgcccatgctccagactctgcgtctgcagatgaacttcatcaaccaggcccagctcggcatcttcagggccttccctggcctgcgctacgtggacctgtcggacaaccgcatcagcggagcttcggagctgacagccaccatgggggaggcagatggaggggagaaggtctggctgcagcctggggaccttgctccggccccagtggacactcccagctctgaagacttcaggcccaactgcagcaccctcaacttcaccttggatctgtcacggaacaacctggtgaccgtgcagccggagatgtttgcccagctctcgcacctgcagtgcctgcgcctgagccacaactgcatctcgcaggcagtcaatggctcccagttcctgccgctgaccggtctgcaggtgctagacctgtcccacaataagctggacctctaccacgagcactcattcacggagctaccgcgactggaggccctggacctcagctacaacagccagccctttggcatgcagggcgtgggccacaacttcagcttcgtggctcacctgcgcaccctgcgccacctcagcctggcccacaacaacatccacagccaagtgtcccagcagctctgcagtacgtcgctgcgggccctggacttcagcggcaatgcactgggccatatgtgggccgagggagacctctatctgcacttcttccaaggcctgagcggtttgatctggctggacttgtcccagaaccgcctgcacaccctcctgccccaaaccctgcgcaacctccccaagagcctacaggtgctgcgtctccgtgacaattacctggccttctttaagtggtggagcctccacttcctgcccaaactggaagtcctcgacctggcaggaaaccagctgaaggccctgaccaatggcagcctgcctgctggcacccggctccggaggctggatgtcagctgcaacagcatcagcttcgtggcccccggcttcttttccaaggccaaggagctgcgagagctcaaccttagcgccaacgccctcaagacagtggaccactcctggtttgggcccctggcgagtgccctgcaaatactagatgtaagcgccaaccctctgcactgcgcctgtggggcggcctttatggacttcctgctggaggtgcaggctgccgtgcccggtctgcccagccgggtgaagtgtggcagtccgggccagctccagggcctcagcatctttgcacaggacctgcgcctctgcctggatgaggccctctcctgggactgtttcgccctctcgctgctggctgtggctctgggcctgggtgtgcccatgctgcatcacctctgtggctgggacctctggtactgcttccacctgtgcctggcctggcttccctggcgggggcggcaaagtgggcgagatgaggatgccctgccctacgatgccttcgtggtcttcgacaaaacgcagagcgcagtggcagactgggtgtacaacgagcttcgggggcagctggaggagtgccgtgggcgctgggcactccgcctgtgcctggaggaacgcgactggctgcctggcaaaaccctctttgagaacctgtgggcctcggtctatggcagccgcaagacgctgtttgtgctggcccacacggaccgggtcagtggtctcttgcgcgccagcttcctgctggcccagcagcgcctgctggaggaccgcaaggacgtcgtggtgctggtgatcctgagccctgacggccgccgctcccgctacgtgcggctgcgccagcgcctctgccgccagagtgtcctcctctggccccaccagcccagtggtcagcgcagcttctgggcccagctgggcatggccctgaccagggacaaccaccacttctataaccggaacttctgccagggacccacggccgaatagccgtgagccggaatcctgcacggtgccacctccacactcacctcacctctgcctgcctggtctgaccctcccctgctcgcctccctcaccccacacctgacacagagcaggcactcaataaatgctaccgaaggcta

SEQ ID NO: 31784 - DNA, 2702 bp, Homo sapiens
gcggggtggagccagcgccctcagcgcgctacggtccgcgggcaactccgcagaagccccagcccccaggaccccaggacccagtggcgcagccggcagccccggatccctgatctgcttgggcagctcctgcagaacctggaacagtgaatgggtaggggacactgggcgtgcagaaggcggggggcagtgtggaacatgccttcaccacctccagcttctgctgccggaggctgcacccacctgtgcccatggcctgcacaggcccatcacttcctagcgccttcgacattctaggtgcagcaggccaggacaagctcttgtatctgaagcacaaactgaagaccccacgcccaggctgccaggggcaggacctcctgcatgccatggttctcctgaagctgggccaggaaactgaggccaggatctctctagaggcattgaaggccgatgcggtggcccggctggtggcccgccagtgggctggcgtggacagcaccgaggacccagaggagcccccagatgtgtcctgggctgtggcccgcttgtaccacctgctggctgaggagaagctgtgccccgcctcgctgcgggacgtggcctaccaggaagccgtccgcaccctcagctccagggacgaccaccggctgggggaacttcaggatgaggcccgaaaccggtgtgggtgggacattgctggggatccagggagcatccggacgctccagtccaatctgggctgcctcccaccatcctcggctttgccctctgggaccaggagcctcccacgccccattgacggtgtttcggactggagccaagggtgctccctgcgatccactggcagccctgcctccctggccagcaacttggaaatcagccagtcccctaccatgcccttcctcagcctgcaccgcagcccacatgggcccagcaagctctgtgacgacccccaggccagcttggtgcccgagcctgtccccggtggctgccaggagcctgaggagatgagctggccgccatcgggggagattgccagcccaccagagctgccaagcagcccacctcctgggcttcccgaagtggccccagatgcaacctccactggcctccctgatacccccgcagctccagaaaccagcaccaactacccagtggagtgcaccgaggggtctgcaggcccccagtctctccccttgcctattctggagccggtcaaaaacccctgctctgtcaaagaccagacgccactccaactttctgtagaagataccacctctccaaataccaagccgtgcccacctactcccaccaccccagaaacatcccctcctcctcctcctcctcctccttcatctactccttgttcagctcacctgaccccctcctccctgttcccttcctccctggaatcatcatcggaacagaaattctataactttgtgatcctccacgccagggcagacgaacacatcgccctgcgggttcgggagaagctggaggcccttggcgtgcccgacggggccaccttctgcgaggatttccaggtgccggggcgcggggagctgagctgcctgcaggacgccatagaccactcagctttcatcatcctacttctcacctccaacttcgactgtcgcctgagcctgcaccaggtgaaccaagccatgatgagcaacctcacgcgacaggggtcgccagactgtgtcatccccttcctgcccctggagagctccccggcccagctcagctccgacacggccagcctgctctccgggctggtgcggctggacgaacactcccagatcttcgccaggaaggtggccaacaccttcaagccccacaggcttcaggcccgaaaggccatgtggaggaaggaacaggacacccgagccctgcgggaacagagccaacacctggacggtgagcggatgcaggcggcggcactgaacgcagcctactcagcctacctccagagctacttgtcctaccaggcacagatggagcagctccaggtggcttttgggagccacatgtcatttgggactggggcgccctatggggctcgaatgccctttgggggccaggtgcccctgggagccccgccaccctttcccacttggccggggtgcccgcagccgccacccctgcacgcatggcaggctggcacccccccaccgccctccccacagccagcagcctttccacagtcactgcccttcccgcagtccccagccttccctacggcctcacccgcaccccctcagagcccagggctgcaacccctcattatccaccacgcacagatggtacagctggggctgaacaaccacatgtggaaccagagagggtcccaggcgcccgaggacaagacgcaggaggcagaatgaccgcgtgtccttgcctgaccacctggggaacacccctggacccaggcatcggccaggaccccatagagcaccccggtctgccctgtgccctgtggacagtggaagatgaggtcatctgccactttcaggacattgtccgggagcccttcatttaggacaaaacgggcgcgatgatgccctggctttcagggtggtcagaactggatacggtgtttacaattccaatctctctatttctgggtgaagggtcttggtggtgggggtattgctacggtcttttaattataataaatatttattgaatgcttccgc

SEQ ID NO: 31785 - DNA, 6708 bp, Homo sapiens
ctcacacttttgctctcttgcagtcagttgctttgctggcttctgcaggcttttaaggtctcgcggcgtagaaatgcctggcccccacccccttcctcggtctcccctttcaattcagatgtgctgatgtgcagaccggattcatcttctcggagctgcggcggcggctttgggctcaggcggcggcggctcgcgctcggccgcggagtcctggcagcagcggggacgcggcgcgggagtccgagctctggtggcagctgagcccgcggggcgccgctcgccgagccgcggccgcgggaagttcggcagccagaaggacgacctggcaggctgcgagcgccagcgccgccagagccgagtttgcctgcgccctccccgcctccgagtgcagagttccttacctgccctccgcccacccgtgggcccctagccaacttctccctgcgactgggggtaacaggcagtgcttgccctctctactgtcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacacttttgatgggaacgaagaggataaaacagagactatagattacaaggacccgtgtaaagccgctgtattttggggcgatattgccttagatgatgaagacttaaatatctttcaaatagataggacaattgaccttacgcagaacccctttggaaaccttggacataccacaggtggacttggagaccatgctatgtcaaagaagcgaggggccctctaccaacttatagacaggataagaagaattggctttggcttggagcaaaacaacacagttaagggaaaagtacctctacaattctcagggcaaaatgagaaaaatcgagttcccagagccgctacatcaagaacggaaagaatatggcctggaggcgttattccttatgttataggaggaaacttcactggcagccagagagccatgttcaagcaggccatgaggcactgggaaaagcacacatgtgtgactttcatagaaagaagtgatgaagagagttacattgtattcacctataggccttgtggatgctgctcctatgtaggtcggcgaggaaatggacctcaggcaatctctatcggcaagaactgtgataaatttgggattgttgttcatgaattgggtcatgtgataggcttttggcatgaacacacaagaccagatcgagataaccacgtaactatcataagagaaaacatccagccaggtcaagagtacaattttctgaagatggagcctggagaagtaaactcacttggagaaagatatgatttcgacagtatcatgcactatgccaggaacaccttctcaagggggatgtttctggataccattctcccctcccgtgatgataatggcatacgtcctgcaattggtcagcgaacccgtctaagcaaaggagatatcgcacaggcaagaaagctgtatagatgtccagcatgtggagaaactctacaagaatccaatggcaacctttcctctccaggatttcccaatggctacccttcttacacacactgcatctggagagtttctgtgaccccaggggagaagattgttttaaattttacaacgatggatctatacaagagtagtttgtgctggtatgactatattgaagtaagagacgggtactggagaaaatcacctctccttggtagattctgtggggacaaattgcctgaagttcttacttctacagacagcagaatgtggattgagtttcgtagcagcagtaattgggtaggaaaaggctttgcagctgtctatgaagcgatctgtggaggtgagatacgtaaaaatgaaggacagattcagtctcccaattatcctgatgactatcgcccgatgaaagaatgtgtgtggaaaataacagtgtctgagagctaccacgtcgggctgacctttcagtcctttgagattgaaagacatgacaattgtgcttatgactacctggaagttagagatggaaccagtgaaaatagccctttgatagggcgtttctgtggttatgacaaacctgaagacataagatctacctccaatactttgtggatgaagtttgtttctgacggaactgtgaacaaagcagggtttgctgctaacttttttaaagaggaagatgagtgtgccaaacctgaccgtggaggctgtgagcagcgatgtctgaacactctgggcagttaccagtgtgcctgtgagcctggctatgagctgggcccagacagaaggagctgtgaagctgcttgtggtggacttcttaccaaacttaacggcaccataaccacccctggctggcccaaggagtaccctcctaataagaactgtgtgtggcaagtggttgcaccaacccagtacagaatttctgtgaagtttgagttttttgaattggaaggcaatgaagtttgcaaatatgattatgtggagatctggagtggtctttcctctgagtctaaactgcatggcaaattctgtggcgctgaagtgcctgaagtgatcacatcccagttcaacaatatgagaattgaattcaaatctgacaatactgtatccaagaagggcttcaaagcacattttttctcagacaaagatgaatgctctaaggataatggtggatgtcagcacgaatgtgtcaacacgatggggagctacatgtgtcaatgccgtaatggatttgtgctacatgacaataaacatgattgcaaggaagctgagtgtgaacagaagatccacagtccaagtggcctcatcaccagtcccaactggccagacaagtacccaagcaggaaagaatgcacttgggaaatcagcgccactcctggccaccgaatcaaattagcctttagtgaatttgagattgagcagcatcaagaatgtgcttatgaccacttagaagtatttgatggagaaacagaaaagtcaccgattcttggacgactgtgtggcaacaagataccagatccccttgtggctactggaaataaaatgtttgttcggtttgtttctgatgcatctgttcaaagaaaaggctttcaagctacacattctacagagtgtggcggacgattgaaagcagaatcaaaaccaagagatctgtactcacatgctcagtttggtgataacaactacccaggacaggttgactgtgaatggctattagtatcagaacggggctctcgacttgaattatccttccagacatttgaagtggaggaagaagcagactgtggctatgactatgtggagctctttgatggtcttgattcaacagctgtggggcttggtcgattctgtggatccgggccaccagaagagatttattcaattggagattcagttttaattcatttccacactgatgacacaatcaacaagaagggatttcatataagatacaaaagcataagatatccagataccacacataccaaaaaataacaccaaaacctctgtcagaacacaaaggaatgtgcataatggagagaagacatattttttttaaaactgaagatattggcacaaatgttttatacaaagagtttgaacaaaaaatccctgtaagaccagaattatctttgtactaaaagagaagtttccagcaaaaccctcatcagcattacaaggatatttgaactccatgcttgatggtattaataaagctggtgaaagggcatcatatacttcaaggaagactctacaagcttttgttcacagcttgaaatagatgcctcacaattcagacagtttaattcaggaactgtgaccctgcagtgttctttttgacaatttgtcaagatttagggacataaaatgatcttgcaggtcgtaaactggaaaacagtattttggttgtcttaggataattgctgactttgtatcttggatacagtgtaaaccagatccatataaggtgaatgtgaaatgggagtcttctgagggtgatttgtactttccatgtgtatgtgtgtgtctggtgtttggaaactgggatatttcagcttcattatttccacttgcaggccagcttaacctctgaaacacaaatgatcttgagaccactttagtgtacttacatttagatgagtttgaaatctcaatggtgtctaattattgcagttaaattctagacatcagttctttaagtctcagaaaacgcccagtgaattggtaaacttagttcttttttttggaagtgctgccttttcacaccaaatccaagaagcctgtgatgtcttatgaaccttatgagaaaactccgaagaggtgtgagcaggattcttctgaatgactgtctggatggttcattactcaagttactgctgctgctattgtctttcctttgttgtcgatctgttattgttgtattattattgttgatgttgtcatggttaatctattttttaaaattgaaatgaagcagaagtaggccttgtgagaactgaaaggtctctttcatttttctcttcctgggattcattttttcaaaacacaatgctggaaaaaaaagatttgtttctgaaagacttcttatggtgctattccataaactttttttcaaacaagtttttgacctttgagccaacccacccgtagactacgaatgtctccctatggctggtagcatttgaagactaaagacttgtcaaatatatcaagagtatatcattgcaagggcagcacttgtcctgtggaacaactacttataatgccttagaattcctgcacatgatcaaacagatcctcctaaaacacaccttttgaaatgttgaacataatagtgtatgttaattaacagctctatgaagaaaatccatttccatgactgaagcattggatataaatatggtgtcctgctttttttgtagaaaatgtaatttgaggatgaattttctgctttaaaggcatgtgtgtttttaaaattaatgaatgtagatgtgtgattgtctgagtgagtgaaactacaagaggtaaaaaataatgggtggttgaaaagttaaaatgtatgtgccaagttctactagaattccatttgaaatagcaccttccttaggtttcatggacaaataatgggaacttctaattttgatcaatcccattaaaaaaaggctctttcctttagagaaactctattttgatgtcaatatagattactgtatgaagtagctttgtgtctgttacctgtccatgagcatacaacattgaatacaattgggtgtattctttcagttttacacaattaaagtatacacacagatgtagcttatctgtttttttcttaaattgttgccctgaaaaaatttcttgcatatgaattgtaaaatgtaaatacatttttataaccaatgttttgatcttattgaatgttactttgaaaatgtataactattgcctgcaatgtagatgagccttttagtagagctgatttattccagtaacttcttccatattttctcactaatctcccgttagccaaaatatgccagaaatgggaaagagaggagaaaaagtcattaacattaacacctatactgttctatactactcctacccgtgtgctaggaatgtgcactagctctttttaaattccatgctacactttgaggactgtcatcatgttctcgttttgtagttcagaaagtgaggctcaaagaatttatgtaaccttcccagagtcacagtgtaaagttagatgttgaaacccagtttatcttatacaaatgagcctctgcttgttctacaaaggtagtagaatcaatctcgacctatataaatagtagattttttatggtgaaactttcccacataaagtaaattttaggggtgaattagagtaaaacttacaggataagcattttgctctttttaagaacagcatgaaatttagaataccaatgatagctatctttaagaatcagaattagtactagaaatttaaaaaaccctatagtttggagttagtatgagccttttgtgaaaataaatatattaaattattttgcctgatgtggtaggggaaatgtattgctctatattaagaaatattctggatattctgattgacatcttattaggccatagtgagctatgctctgcacaactgagaaattaggtatttagaaggcatatagagatgttgtcataactaggtcttcaacgtgaaaattaatttttattgtatcatgtcaagtatcagtttaccacatattatttttatattaattcaacatttgccttaagtgtgttgttaaatgaaagtacagacagcttcattgttgtattgttaataattgttacttactgctccaggcattttattaaattaattttttaaattattttccaccctacatcagtatattggttgtgctttatatttgccaaagtcctaactgactatacatagaaaaaaaaaaaaacactgttctcacttgattttattaaattatttttaaaagtc

SEQ ID NO: 31786 - DNA, 1829 bp, Homo sapiens
tcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacacttttgatgggaacgaagaggataaaacagagactatagattacaaggacccgtgtaaagccgctgtattttggggcgatattgccttagatgatgaagacttaaatatctttcaaatagataggacaattgaccttacgcagaacccctttggaaaccttggacataccacaggtggacttggagaccatgctatgtcaaagaagcgaggggccctctaccaacttatagacaggataagaagaattggctttggcttggagcaaaacaacacagttaagggaaaagtacctctacaattctcagggcaaaatgagaaaaatcgagttcccagagccgctacatcaagaacggaaagaatatggcctggaggcgttattccttatgttataggaggaaacttcactggcagccagagagccatgttcaagcaggccatgaggcactgggaaaagcacacatgtgtgactttcatagaaagaagtgatgaagagagttacattgtattcacctataggccttgtggatgctgctcctatgtaggtcggcgaggaaatggacctcaggcaatctctatcggcaagaactgtgataaatttgggattgttgttcatgaattgggtcatgtgataggcttttggcatgaacacacaagaccagatcgagataaccacgtaactatcataagagaaaacatccagccaggtcaagagtacaattttctgaagatggagcctggagaagtaaactcacttggagaaagatatgatttcgacagtatcatgcactatgccaggaacaccttctcaagggggatgtttctggataccattctcccctcccgtgatgataatggcatacgtcctgcaattggtcagcgaacccgtctaagcaaaggagatatcgcacaggcaagaaagctgtatagatgtccagcatgtggagaaactctacaagaatccaatggcaacctttcctctccaggatttcccaatggctacccttcttacacacactgcatctggagagtttctgtgaccccaggggagaaggttgtattttcactctgttgattgtgtcttctgatgaacacaaattataaagtttgatgtcataccacttgtctacttttagttttattgcctgtgcttttggtgtcatagccaagaaatcatggccatatgtaatgacatgaagtttttaccctgtgttttcttctatgagttctatagttttacagtcttatatgtaggtttttaatcaatattgtgttaatagaaaccattcttgtacatgtggatatccagtttcttcaacaccatttgttaaagatttactaaatgtttttattcagcattcctgctcatgtttctgacttctattatggcttattttggtcctgcctatagcttacattatagattattttttaaattagcgtttttgtttttttctgtttgaaaatgtggattttttacatgaatttataaaactatagtttcactggatatagttggctgcacatttaactttgttttaaataaaagcttgcaaaaat

SEQ ID NO: 31787 - DNA, 6756 bp, Homo sapiens
gcagcctcggccgccgggcaagtagctccgagcggctgcttcccggttgcctcgacgaagacagggggcgccgcgctccgcttgctccgcgcctgagccatgcccagcagccctgtgtaaccaccgagtcccggccggagccgaccgacccagtgtgcgccgtctttcggccgagctgagctttcgtgcacgcaactccctctgccccagccggccccgcgccaccatgccccgggcgactgcacttggggccctggtgtcactgctgctgctgctgccgctgcctcgcggcgccgggggactcggggagcgcccggacgccaccgcagactactcagagctggacggcgaggagggcacggagcagcagctggagcattaccacgacccttgcaaagccgctgtcttttggggagacattgccttagatgaagatgacttgaagctgtttcacattgacaaagccagagactggaccaagcagacagtgggggcaacaggacacagcacaggtgggcttgaagagcaggcatctgagagcagcccagacaccacagccatggacactggcaccaaggaagctggaaaggatggccgggagaataccacactcctgcacagccctgggaccttgcatgccgcagccaagaccttctctccccgggtccgaagagccacaacctcaaggacagagaggatatggcctggaggagtcatcccctacgtcattggagggaacttcactgggagccagagggccatttttaagcaggccatgagacactgggagaagcacacctgtgtgaccttcatagaaaggacggatgaggaaagctttattgtattcagttacagaacctgtggctgttgctcctatgttgggcgccgaggaggaggcccacaggccatatccattgggaagaactgtgacaagtttggcattgtggctcacgagctgggccatgtggttgggttttggcatgaacacacccggccagacagagaccaacatgtcaccatcatcagggaaaacatccagccaggtcaggagtataatttcttaaaaatggaagctggggaagtgagctctctgggagagacatacgactttgacagcatcatgcactacgcccggaacaccttctcaagaggagttttcttagacaccatccttccccgtcaagatgacaatggcgtcaggccaaccattggccagcgcgtgcggctcagtcagggagacatagctcaagcccggaagctgtacaaatgcccagcgtgtggggagaccctgcaggacacaacgggaaacttttctgcacctggtttcccaaatgggtacccatcttactcccactgcgtctggaggatctcggtcaccccaggggaaaagatcgtattaaacttcacatccatggatttgtttaaaagccgactgtgctggtatgattacgtggaggtccgggatggttactggagaaaagccccccttttgggcaggttttgtggcgataagatcccggagcccctcgtctccacggacagccggctctgggtggagttccgcagcagcagcaacatcttgggcaagggcttctttgcagcgtacgaagctacctgcgggggagacatgaacaaagatgccggtcagattcaatctcccaactatccggatgactacagaccttccaaggaatgtgtctggaggattacggtttcagaggggtttcacgtgggacttaccttccaagcttttgagattgaaaggcacgacagctgtgcatatgactacctggaagtccgggatggccccacggaagagagtgccctgatcggccacttttgtggctatgagaagccggaggatgtgaaatcgagctccaacagactgtggatgaagtttgtgtccgatggctctatcaataaagcgggctttgcagccaattttttcaaggaggtggatgagtgttcctggccagatcacggcgggtgcgagcatcgctgtgtgaacacgctgggcagctacaagtgtgcctgtgaccctggctacgagctggccgccgataagaagatgtgtgaagtggcctgtggcggtttcattaccaagctgaatggaaccatcaccagccctgggtggccgaaggagtatcccacaaacaaaaactgtgtctggcaggtggtggcccccgctcagtaccggatctcccttcagtttgaagtgtttgaactggaaggcaatgacgtctgtaagtacgactttgtagaggtgcgcagcggcctgtcccccgacgccaagctgcacggcaggttctgcggctctgagacgccggaggtcatcacctcgcagagcaacaacatgcgcgtggagttcaagtccgacaacaccgtctccaagcgcggcttcagggcccacttcttctcagataaggacgagtgtgccaaggacaacggcgggtgtcagcatgagtgcgtcaacaccttcgggagctacctgtgcaggtgcagaaacggctactggctccacgagaatgggcatgactgcaaagaggctggctgtgcacacaagatcagcagtgtggaggggaccctggcgagccccaactggcctgacaaataccccagccggagggagtgtacctggaacatctcttcgactgcaggccacagagtgaaactcacctttaatgagtttgagatcgagcagcaccaggaatgtgcctatgaccacctggaaatgtatgacgggccggacagcctggcccccattctgggccgtttctgcggcagcaagaaaccagaccccacggtggcttccggcagcagtatgtttctcaggttttattcggatgcctcagtgcagaggaaaggcttccaggcagtgcacagcacagagtgcgggggcaggctgaaggctgaagtgcagaccaaagagctctattcccacgcccagtttggggacaacaactacccgagcgaggcccgctgtgactgggtgatcgtggcagaggacggctacggcgtggagctgacattccggacctttgaggttgaggaggaggccgactgcggctacgactacatggaagcctacgacggctacgacagctcagcgcccaggctcggccgcttctgtggctctgggccattagaagaaatctactctgcaggtgattccctgatgattcgattccgcacagatgacaccatcaacaagaaaggctttcatgcccgatacaccagcaccaagttccaggatgccctgcacatgaagaaatagtgctgatgttcttgaaagacagaaactgagaattttttttgttttgttttgtttttaacaacaatagcaccttgaaaatctgccctaaaacagtgtacagtatttttctcaaacaaaaactcagaatccagccttagaggtatatatttgaatgaaagtcttgtaagtttggccaacaaggtggagagaaaaatgttcttttgcttctgtctgcaatgttatcattcatgaactgttaaagtgttaaagattaggattgaagtcactgaccattccggctatgcttcttcataccattctccttgtcccttgctcctatgtggcaaaaggtcagccttggggttggccgttcctctaatctggacttgcttgcaaaggtgccaggctgtcttctgtccatgttgggcataagggatgaaaacttggccgagactaatgtgtggcccacagctttggctggaatcattttctttctctctgccagggacatgtcaaccaagaaacctgaaaatatggatggatgtcaggactaaaaaaaggcatcacagtgagcagtgagcacagagggagtttcgagtataagaatcattgtcatgaagttaggagaccacaaagccatttctcagagtcattcactctccttgtccctttggtttccccccctccctaattgcagtgggggctaaggcatccattatgaatacagcagaacatttgctggcgagagtcctgtctgctgagaagacaatattgtggctcgtcctgatatttttttcattcattgactttgagaagactccacctgtgcttggaattccatgggcttcaaagaacatttcttcttttagctttggaggcacttgccgtggcacacctggactccttgacatccaattcaaactgcatttgcaaaatgtgcaaagacctcttatgagggaccaattcaggtcccttatggggtgaacactgttgaagactggttaattataagttatgtaagaatcatcgccttgtggaacaagtcaatcagtgactagcttcctgtagccaatcaggttaaagagtgcgttggtaactttgctctgattaactagtattcaatcaccaacttgcaaacagaattcataacacttggcacttgttctagagaagtgtagaggatgatgtttacataattttagcacctcaaggtataatttaaacagtgaggtagttttgaatggcatttcattaaggcatctatgggcattatgagctaaaagctgtggtatgttagctttaaaagagtatttatgttggaataatttttaaataatgtttacataactgtaagtcctgtttggttgttgttggacgcagggcggcacatgagtgtttttggttagagccaagatagctcccatgcaccggaattcctttgggatgaatcagcatcattttaaacaaagtatatgtaaaaggtgaaaggttatattttttacagatcagaatgtggcaccagaggactgtgtctcattaaagtgattgctgggagcaaaaactagaatgatacaaagaaaggtcagagaaatgcatgggaatattttttccttaaaacagaaaaaaattaaagtattattaataatatatgtctgtatatatgtatgtatgtaaaagatcagctgtcaaagccttaatcaatgcagtgtggaaaatgccaacccctggtcctcgctttactgtgggccctgcaggactggctctccatttcctgcctctcctttcaccaagctctgttttggcctttctcggccctggactgaggctcagcctacacgctcatattgtgcatatggcagaccctgcccagcgtgcgctttgatacagcaaatggagcagctgacctcatggctccaatcccacctgcctgttagggtagattccatttatctgatttttgtattttctgaggttttatttggtctcatcttgtctatgagagttgaaactggaactgggaaacctaagatgggtgttatggttctttctccaaggaaataaaaattctgcagttttaacctttagaagtctaagcaagattaacaaatttcatagaaaagtgggagggagtcagaaacagagttggtgctgctcagcaggacggtgaaacaatgatacttctttttatctctttagtatgaacattttcaaaaacacacagcttcaacaattgtcaccatatggccaatttgcaacaatgggactcttatgaaaaacctttatttaggccttctgtgtgacgtatccacagaaaagagaagctctgattcagctggggctagctgggccgctcctctggaagcccacacttgtggggacttaggcatgacacaggttcttgcaaagaaactagaggctggcttcactagagagagtccattcagcagaaagtcccaggcctctgccttggtgcttccaattatcagtgacctgcctgcaagcatccccagaagcaaacagcagaggtagaagatatcactgcagcctgctttgtgctttaattgggtaccaagctttggggatgacagtgagttgcaagaatagttttagttcagagaattgtcttaggacaacaggctaatgaaggatttggggtctgggtttttagcctggctccgttctggtgtaacccggtctagcaaaagctaagcctggattgcagggcaggaaaaaatctggaattaactttagccagtggaatttcttcaaacagagaaagagaggctgttcattgatccactattccctctattttcctctaaggtaaatatttagaggtatttacctgtaaggtgaagtttcctttttatttctactttacaatttctctctaaagcaagcttgtccaacccttggcccaggacggctttgaatatggcccgacacaaattcgtaaactttttaaaaaacattgtaagattctttctgtgatttttttttttctcgtcagctatcgttagtgtattttatgtgtggcccaagataattcttcttccaatgtggcccagggaagccaaaagatgggacacccctgctgtaaagtttcatatcactcatgaattgctcagctgatttaaataatttgtaaaatcctgctaactagcaaattcacattgagattttctattgattgggtccctttgatagctttcagattggtattgttagcgttccatttgtgaacaaatgttcccttggctttagcagatgtttttaaagtttcttttgtagaccgaacttctgaagagtaataccaaatgcctaaaattttatttttaaaaaggaaaattgtttaaagtattatatgtaaacatatgggtattttttattttgtgtaattttacatttcatgaaatgatgtcagtttcaaagagaaagtggagaggacctaacatatgtctctacctagaacggatggtttcattaaagaatgtggatttatt

SEQ ID NO: 31788 - DNA, 3738 bp, Homo sapiens
agcccaaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaatggaaa

SEQ ID NO: 31789 - DNA, 1958 bp, Homo sapiens
ggcccagcttgtcgctctttcccggaggctggcagatgcgcgtggtgcggctgctgcggctccgggcggctctgacgctgctcggggaggtcccccgccgcccggcctcccggggtgtcccgggctcgcgcaggacgcagaagggcagtggagccaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggcggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaataaaatgtgtgcaagtgcttgtacatcactagaaaaa

SEQ ID NO: 31790 - DNA, 1868 bp, Homo sapiens
gctcgggccttcccggcgtctccgcgcaggcctcggggaagcggggtccgggggagccgtggtgcggtgggaccgcgtgggtcctggaagagctgcagaggaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggcggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaat

SEQ ID NO: 31791 - DNA, 1960 bp, Homo sapiens
gagccgtggtgcggtgggaccgcgtgggtcctggaagagctgcagaggagagtgacggctttggatgcgctttgccccagggcctttcttcccggagttggccttttccctgcccttctcttctcctggcgtggtgacctgcctcccttctcctggatcgctttgctggcagccaccttgtaacacctcaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggcggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaataaaa

SEQ ID NO: 31792 - DNA, 1982 bp, Homo sapiens
ccggcctcccggggtgtcccgggctcgcgcaggacgcagaagggcagtggagccaggcacaagccgcatggatccagtggccctggtggccgttggtggtcccaggcgctttcctggaggacatgtgagaagccctgccggcgcatactgggcctggggtagccgcatggggatgggtctctgcgcatgaaatgctggagtttccgaagagctggagagttgacagcctcactggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggcggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtact

SEQ ID NO: 31793 - DNA, 5378 bp, Homo sapiens
ggggtaggggcggcgccgagtcgggggagggggctgtgcgccgggctggcgcccgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgtgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacataagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacaggctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggaagaagactatgaatggggaagtagttccatacttgatgttctgactggaatcaatgtacagcaacgaagactagcacttgcagcaatgagatggagaaaaaaaatccagcaaagacaagaatctggcattgttgagggagcatttagtgggtggaaggttattttacatgtggatcagtctcgagaagcaggcttcaaacgccttcttcagtcaggaggagcaaaggtgctacctggtcattctgtacctttatttaaagaggccacacatcttttttctgacttgaataaactgaaaccagatgactcaggagttaatatagcagaagctgctgcccagaacgtgtactgcttgagaacagaatacattgctgattatctcatgcaggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaattagtattaagatgtgtttacatagataaattttttaaaagagcaccctggcatctgttcttctgttgaagcaacaa

SEQ ID NO: 31794 - DNA, 4098 bp, Homo sapiens
tgaagaaatagggcctttccgcctgcgggcccagtgagtcgacacggtgggggcccgcgatccccgggacttaccactgaataaatccagtccagcgtgcgacgacttactggcttcatggggtcgcagccgccgctggggtctccgctgtctcgcgaggagggtgaagcgcccccgcctgctcccgcttcggagggtaggcggagaagtcgccgggtacgccttcgcggatcctgccgacaccgacctagctttctgggctgccgggagctcgcggcgagcgccccagccaggcctgcgccggcatcctccgagataatggcatcagctgctaaggaatttaaaatggacaacttttcacctaaagctggcactagcaaattgcaacagacagtaccagctgatgcatctcctgattctaagtgtcctatatgcttggatagatttgataatgtgtcttacttagatcgctgcttacataagttctgttttcgctgtgtacaggagtggtcaaaaaacaaagctgaatgcccactatgtaaacagccctttgattctattttccattctgtgagggcagaagatgacttcaaggagtatgtcctaaggccttcgtataatggttcttttgtcacccctgatcgacgatttcgctaccgtacaactctgacaagggaacgaaatgcttctgtgtattcacctagtggtcctgtgaacagaagaacaacaactccaccggatagtggagtactgtttgaagggttaggcatttcaacaagacctagagatgttgaaattcctcagtttatgagacagattgcagtaaggaggccaactacggcagatgaaagatctttgcggaaaattcaagaacaagatattattaattttagacgaactctttatcgtgctggtgctcgagttagaaatattgaagatggtggccgctacagggatatttcagctgaatttttccgtagaaatccagcttgccttcacagattagtcccctggttaaaacgtgaacttacagttctttttggagctcatggatctttagtgaatattgtccagcatattatcatgagtaatgttactcgctatgacttggagagtcaggcatttgtgtctgatttaagaccatttttacttaatcgaactgagcattttatacatgaatttatcagttttgcccgatctccttttaacatggcagcctttgaccagcatgccaattatgattgccctgctccttcatacgaagaaggcagccattctgattcttcagtcataacaatatctccagatgaggctgagacccaagagctggatattaatgtagccactgttagtcaggcaccatgggatgatgaaactccaggaccatcttactcaagctcagagcaggtacacgttactatgtcttctcttttaaatacttctgacagttcagatgaagaacttgtcacaggaggagccacgtctcagatacaaggagtacaaaccaatgacgacctaaataatgacagtgatgattcttcagataattgtgtcattgttgggtttgttaaaccactagctgagaggaccccagaacttgttgaactgtcctctgattctgaggacttaggttcttatgagaaaatggagacagtgaagacacaagaacaggagcaatcttacagttctggtgatagcgatgttagtagatgctcatctccacactctgtccttggaaaggatgaacaaataaataaaggtcattgtgattctagtacaagaatcaaatcaaagaaggaagagaaacgatctacatcattgtcatctcccagaaacctgaactcatctgtaagaggagacagagtatattctccatataaccatagacacagaaagaggggaagatcaagaagttcagattcacgttctcagagtagaagtgggcatgatcagaagaatcatagaaagcatcatgggaagaaaagaatgaaaagtaaacgatccagaagcagggaaagtagcagacctagagggagaagagacaaaaagagatcaagaactagagatagcagttggtccagaagaagccaaactctgtctctaagtagtgaaagcacaagcagatcaaggtctcgtagcagtgatcatggtaaaagaagatcacggagcagaaatagagatcgttattatttaagaaataattatggaagcagatacaaatgggagtatacttattacagtagaaacaaggacagggatgggtacgaatcatcttacaggaggaggactctgtccagagctcattattctagacagtcttcaagtccagaatttagagttcagtccttttctgaaagaacaaatgctaggaaaaaaaataatcacagtgagaggaagtattactactatgaaaggcacagatcaaggagcctgtctagtaacagatcaaggactgcatctaccgggactgaccgggtgagaaatgaaaagcctggagggaaacgaaaatacaaaacacggcatttggagggtactaacgaagtggctcagccatctcgtgaatttgcttctaaagcaaaggacagtcattaccaaaaatcttcatcaaaattggatggaaactacaaaaatgagagtgataccttttcagacagccgatcatcagacagagagacaaaacacaaaaggagaaaaaggaagacccggagcctaagtgtagagatagtttatgaaggaaaagctactgatacaactaaacaccataaaaagaaaaagaagaaacataagaagaagcataagaaacaccatggagataatgcttcacgttccccagttgtaattaccattgacagtgacagtgataaggattctgaagtaaaggaggatacagaatgtgacaatagtggtcctcaagaccctctacaaaatgagtttttggctccttccttggaaccatttgaaactaaagatgtagttacaatagaagctgaatttggtgtgctggacaaggaatgtgatattgccacacttagtaacaacttgaataatgccaacaaaactgtagataatattccacctctggcagcttcagttgaacaaactctcgatgtaagagaagagagcacctttgtttctgatttggagaaccagcccagtaacattgtgtctcttcaaactgagccatcaaggcaattgccatcgccacggacatcattaatgtcagtatgtcttggtagagactgtgatatgtcttaaaactgccaaagcatttcattgagaattatgatgttataaaaaggaaaaaggaagaatgtcgtctactgcagtctatttaaagatgacatttggtgaaaactctcttcctccttacaatattttaaatgattttttttttggtgttaatttgtaaaaatcattatttgttcaaaatgtatgtcccaccctcaaagatatgcacttttaagtgaagaaaatgatactgctagcagcttatttaaaacttggggtcctttttaaataagaaaaattatataaattttagaagttatttcataaagccatacggtattgacatatttttaaggtagtcaatgagtatttttgaattttttttttttgagagttattctggaaatgtgttataagctaggagaatccctttggacagtctttatttttcttcttaaaaatttatatgattcaaaaccatttcttcaggttaaattgaggcattttaatctgcacagtttatcttctgccaaaataaaaatttactatttcctttatatacttgtttatctggactgccagtaaaacaaatgtgtattcaacaaaagaaaaaaaataaaacagtaacactttaaaacaagaatcagacattttcctatgcagtatttttttttaaagtttattttagtaaagttaaaatcttgaaagtagctaagggcataattatgtcataaatactgaacttcaggtgaacaaatactttatagttttaattattttctttgattttgaggagtatcttatttgctttctatcatcagtaaaaacagcatttaacttgctaaataaacatgaaaaacccttgtcata

SEQ ID NO: 31795 - DNA, 3621 bp, Homo sapiens
tgaagaaatagggcctttccgcctgcgggcccagtgagtcgacacggtgggggcccgcgatccccgggacttaccactgaataaatccagtccagcgtgcgacgacttactggcttcatgataatggcatcagctgctaaggaatttaaaatggacaacttttcacctaaagctggcactagcaaattgcaacagacagtaccagctgatgcatctcctgattctaagtgtcctatatgcttggatagatttgataatgtgtcttacttagatcgctgcttacataagttctgttttcgctgtgtacaggagtggtcaaaaaacaaagctgaatgcccactatgtaaacagccctttgattctattttccattctgtgagggcagaagatgacttcaaggagtatgtcctaaggccttcgtataatggttcttttgtcacccctgatcgacgatttcgctaccgtacaactctgacaagggaacgaaatgcttctgtgtattcacctagtggtcctgtgaacagaagaacaacaactccaccggatagtggagtactgtttgaagggttaggcatttcaacaagacctagagatgttgaaattcctcagtttatgagacagattgcagtaaggaggccaactacggcagatgaaagatctttgcggaaaattcaagaacaagatattattaattttagacgaactctttatcgtgctggtgctcgagttagaaatattgaagatggtggccgctacagggatatttcagctgaatttttccgtagaaatccagcttgccttcacagattagtcccctggttaaaacgtgaacttacagttctttttggagctcatggatctttagtgaatattgtccagcatattatcatgagtaatgttactcgctatgacttggagagtcaggcatttgtgtctgatttaagaccatttttacttaatcgaactgagcattttatacatgaatttatcagttttgcccgatctccttttaacatggcagcctttgaccagcatgccaattatgattgccctgctccttcatacgaagaaggcagccattctgattcttcagtcataacaatatctccagatgaggctgagacccaagagctggatattaatgtagccactgttagtcaggcaccatgggatgatgaaactccaggaccatcttactcaagctcagagcaggtacacgttactatgtcttctcttttaaatacttctgacagttcagatgaagaacttgtcacaggaggagccacgtctcagatacaaggagtacaaaccaatgacgacctaaataatgacagtgatgattcttcagataattgtgtcattgttgggtttgttaaaccactagctgagaggaccccagaacttgttgaactgtcctctgattctgaggacttaggttcttatgagaaaatggagacagtgaagacacaagaacaggagcaatcttacagttctggtgatagcgatgttagtagatgctcatctccacactctgtccttggaaaggatgaacaaataaataaaggtcattgtgattctagtacaagaatcaaatcaaagaaggaagagaaacgatctacatcattgtcatctcccagaaacctgaactcatctgtaagaggagacagagtatattctccatataaccatagacacagaaagaggggaagatcaagaagttcagattcacgttctcagagtagaagtgggcatgatcagaagaatcatagaaagcatcatgggaagaaaagaatgaaaagtaaacgatccagaagcagggaaagtagcagacctagagggagaagagacaaaaagagatcaagaactagagatagcagttggtccagaagaagccaaactctgtctctaagtagtgaaagcacaagcagatcaaggtctcgtagcagtgatcatggtaaaagaagatcacggagcagaaatagagatcgttattatttaagaaataattatggaagcagatacaaatgggagtatacttattacagtagaaacaaggacagggatgggtacgaatcatcttacaggaggaggactctgtccagagctcattattctagacagtcttcaagtccagaatttagagttcagtccttttctgaaagaacaaatgctaggaaaaaaaataatcacagtgagaggaagtattactactatgaaaggcacagatcaaggagcctgtctagtaacagatcaaggactgcatctaccgggactgaccgggtgagaaatgaaaagcctggagggaaacgaaaatacaaaacacggcatttggagggtactaacgaagtggctcagccatctcgtgaatttgcttctaaagcaaaggacagtcattaccaaaaatcttcatcaaaattggatggaaactacaaaaatgagagtgataccttttcagacagccgatcatcagacagagagacaaaacacaaaaggagaaaaaggaagacccggagcctaagtgtagagatagtttatgaaggaaaagctactgatacaactaaacaccataaaaagaaaaagaagaaacataagaagaagcataagaaacaccatggagataatgcttcacgttccccagttgtaattaccattgacagtgacagtgataaggattctgaagtaaaggaggatacagaatgtgacaatagtggtcctcaagaccctctacaaaatgagtttttggctccttccttggaaccatttgaaactaaagatgtagttacaatagaagctgaatttggtgtgctggacaaggaatgtgatattgccacacttagtaacaacttgaataatgccaacaaaactgtagataatattccacctctggcagcttcagttgaacaaactctcgatgtaagagaagagagcacctttgtttctgatttggagaaccagcccagtaacattgtgtctcttcaaactgagccatcaaggcaattgccatcgccacggacatcattaatgtcagtatgtcttggtagagactgtgatatgtcttaaaactgccaaagcatttcattgagaattatgatgttataaaaaggaaaaaggaagaatgtcgtctactgcagtctatttaaagatgacatttggtgaaaactctcttcctccttacaatattttaaatgattttttttttggtgttaatttgtaaaaatcattatttgttcaaaatgtatgtcccaccctcaaagatatgcacttttaagtgaagaaaatgatactgctagcagcttatttaaaacttggggtcctttttaaataagaaaaattatataaattttagaagttatttcataaagccatacggtattgacatatttttaaggtagtcaatgagtatttttgaattttttttttttgagagttattctggaaatgtgttataagctaggagaatccctttggacagtctttatttttcttcttaaaaatttatatgattcaaaaccatttcttcaggttaaattgaggcattttaatctgcacagtttatcttctgccaaaataaaaatttactatttcctttatatacttgtttatctggactgccagtaaaac

SEQ ID NO: 31796 - DNA, 2076 bp, Homo sapiens
accggttcgcggtcggcgcgagaacaagcagggtggcgcgggtccgggcatgaagctgggccgggccgtgctgggcctgctgctgctggcgccgtccgtggtgcaggcggtggagcccatcagcctgggactggccctggccggcgtcctcaccggctacatctacccgcgtctctactgcctcttcgccgagtgctgcgggcagaagcggagccttagccgggaggcactgcagaaggatctggacgacaacctctttggacagcatcttgcaaagaaaatcatcttaaatgccgtgtttggtttcataaacaacccaaagcccaagaaacctctcacgctctccctgcacgggtggacaggcaccggcaaaaatttcgtcagcaagatcatcgcagagaatatttacgagggtggtctgaacagtgactatgtccacctgtttgtggccacattgcactttccacatgcttcaaacatcaccttgtacaaggatcagttacagttgtggattcgaggcaacgtgagtgcctgtgcgaggtccatcttcatatttgatgaaatggataagatgcatgcaggcctcatagatgccatcaagcctttcctcgactattatgacctggtggatggggtctcctaccagaaagccatgttcatatttctcagcaatgctggagcagaaaggatcacagatgtggctttggatttctggaggagtggaaagcagagggaagacatcaagctcaaagacattgaacacgcgttgtctgtgtcggttttcaataacaagaacagtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggagagagttttctcagataaaggctgcaaaacggtgttcaccaagttagattattactacgatgattgacagtcatgattggcagccggagtcactgcctggagttggaaaagaaacaacactcagtccttccacacttccacccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatagcccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgc

SEQ ID NO: 31797 - DNA, 1984 bp, Homo sapiens
accggttcgcggtcggcgcgagaacaagcagggtggcgcgggtccgggcatgaagctgggccgggccgtgctgggcctgctgctgctggcgccgtccgtggtgcaggcggtggagcccatcagcctgggactggccctggccggcgtcctcaccggctacatctacccgcgtctctactgcctcttcgccgagtgctgcgggcagaagcggagccttagccgggaggcactgcagaaggatctggacgacaacctctttggacagcatcttgcaaagaaaatcatcttaaatgccgtgtttggtttcataaacaacccaaagcccaagaaacctctcacgctctccctgtttgtggccacattgcactttccacatgcttcaaacatcaccttgtacaaggatcagttacagttgtggattcgaggcaacgtgagtgcctgtgcgaggtccatcttcatatttgatgaaatggataagatgcatgcaggcctcatagatgccatcaagcctttcctcgactattatgacctggtggatggggtctcctaccagaaagccatgttcatatttctcagcaatgctggagcagaaaggatcacagatgtggctttggatttctggaggagtggaaagcagagggaagacatcaagctcaaagacattgaacacgcgttgtctgtgtcggttttcaataacaagaacagtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggagagagttttctcagataaaggctgcaaaacggtgttcaccaagttagattattactacgatgattgacagtcatgattggcagccggagtcactgcctggagttggaaaagaaacaacactcagtccttccacacttccacccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatagcccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgcc

SEQ ID NO: 31798 - DNA, 2769 bp, Homo sapiens
tcctgccgcttggccgcggggcgcctggctcagtggcttctgcgggcttcgaggagcgggatgttgcgggctgggtggctccggggcgcggcggcgctggcgctgctgctggcggcccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcagcaatgcaggcggggaccttataactaagacggctcttgacttttggcgggccggaagaaagagggaagacattcagctgaaggacctggaacctgtactgtctgtcggagtcttcaataataaacacagtggcctgtggcacagtggactgatcgacaaaaacctcattgattactttatccccttcctgcctttggagtacagacatgtgaaaatgtgtgtgagggccgagatgagggcccgtggttctgccatagatgaagacattgtcacaagagtggcagaggaaatgacgtttttccccagagacgagaaaatctactcagacaagggctgcaagactgtgcagtcgcggctggatttccactgagctcctatccagatggggtaggagacagctgggaggctccgcacgccagaggccttgcctttcagaagaaccctgaagaccgctttggggttttgcctgtttgcaccttagacttttgggtatagaatcttttttttgagaagaggtctcactccgtcatccaagctggagtgcagtggtgcaatcctcaactcactgcaacctccgctcccggtttgagtgattctcatgcctcagcctcccgagtagctgggattacaggcatgagccactgtgcccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcacccgcgcctcagaagctacggtcacaactaaaggagtccagggacttgctgcaggctggggggcactgggtggttctcaccagcaggctgcggggcactgtgttctcattggccaaaaacatccttttgctctgtctcgttctttacacagagttcactgacttgaagtatactcagttaaaatcggggctggaggtgcagacggtgtctgaccggaggatgtggccgtgcccgccgagcactcttgatctgagctgacctgtgtgtgtgtgtgtgggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccaccttt

SEQ ID NO: 31799 - DNA, 702 bp, Homo sapiens
cccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccagagttcactgacttgaagtatactcagttaaaatcggggctggaggtgcagacggtgtctgaccggaggatgtggccgtgcccgccgagcactcttgatctgagctgacctgtgtgtgtgtgtgtgggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctc

SEQ ID NO: 31800 - DNA, 2631 bp, Homo sapiens
gcttcgaggagcgggatgttgcgggctgggtggctccggggcgcggcggcgctggcgctgctgctggcggcccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccctgtttgtatcgactctgcacttccctcatgagcagaagataaaactgtaccaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcagcaatgcaggcggggaccttataactaagacggctcttgacttttggcgggccggaagaaagagggaagacattcagctgaaggacctggaacctgtactgtctgtcggagtcttcaataataaacacagtggcctgtggcacagtggactgatcgacaaaaacctcattgattactttatccccttcctgcctttggagtacagacatgtgaaaatgtgtgtgagggccgagatgagggcccgtggttctgccatagatgaagacattgtcacaagagtggcagaggaaatgacgtttttccccagagacgagaaaatctactcagacaagggctgcaagactgtgcagtcgcggctggatttccactgagctcctatccagatggggtaggagacagctgggaggctccgcacgccagaggccttgcctttcagaagaaccctgaagaccgctttggggttttgcctgtttgcaccttagacttttgggtatagaatcttttttttgagaagaggtctcactccgtcatccaagctggagtgcagtggtgcaatcctcaactcactgcaacctccgctcccggtttgagtgattctcatgcctcagcctcccgagtagctgggattacaggcatgagccactgtgcccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcacccgcgcctcagaagctacggtcacaactaaaggagtccagggacttgctgcaggctggggggcactgggtggttctcaccagcaggctgcggggcactgtgttctcattggccaaaaacatccttttgctctgtctcgttctttacacagagttcactgacttgaagtatactcagttaaaatcggggctggaggtgcagacggtgtctgaccggaggatgtggccgtgcccgccgagcactcttgatctgagctgacctgtgtgtgtgtgtgtgggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccaccttt

SEQ ID NO: 31801 - DNA, 1182 bp, Homo sapiens
ggctaggccggcagccggatggtcccgcagctcggggccggccatgcttcgcggtccgtggcgccagctttggctctttttcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggctggcgccttcctctgttgggccagcggtacctggacctcctgaccacgtggtactgcagcttcaaagactgctgccctagaggggattgcagaatctccaacaactttacaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcagtaatctcaggggcgatataatcaatgaggtggtcctaaagttgctcaaggctggatggtcccgggaagaaattacgatggaacacctggagccccacctccaggcggagattgtggagaccataggtttttcatttctaacaaccagatggccccacctggacctgccaaccagttctgtggcccccacctaggaactgactcagcagaagagaacagcttcgattccccatgcttttactcaccaaattatccttaaaaactctgatccccaagttttctgagactgatttgagtaataataaaactccggtctcccgca

SEQ ID NO: 31802 - DNA, 519 bp, Homo sapiens
gggcttaagggagcctggctaggccggcagccggatggtcccgcagctcggggccggccatgcttcgcggtccgtggcgccagctttggctctttttcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggctggcgccttcctctgttgggccagcggtacctggacctcctgaccacgtggtactgcagcttcaaagactgctgccctagaggggattgcagaatctccaacaactttacaggcaagaacttcgtggcacggatgctggtggagaacctgtatcgggacgggctgatgagtgactgtgtcaggatgttcatcgccacgt

SEQ ID NO: 31803 - DNA, 2724 bp, Homo sapiens
cggatttttatgagatataattacattgacatgacgcctcatgatttacccatgactcggggggtttccaaactccaaacacctccagactggagcccgtcaatcagcttcctcttgcttttcgtggactcccactgtggaaacctgctggtgttttgctgcggtttcatttccctctgcggaggagccagggcaaccttggccagacaggcacctagctgtgcccttctttccagggcctcttctccactcagctgactcccctggcctgcctaacgctcctgactgagacggttttccggcttcctctaacaggttggcgggaagttgatctgcaaacgcgaggcaaagcaggagtgtccttattcggtaggcctctgatgggccaccagagccgtccgaaagtcctagcggagtgattgacagtggccatttcaaagcctgagttcaccttctttgcaaccacaatcacgacccagaataaactgcttcctggaagccggctagttgcacctggcctgaagtcagtctcgggactgcctctcaggaccccagacagggtttcgggttcccgcctgggtcacgtgtacggaggctgccagtgcgcactcagcccggcccgccggtcgccacagcaacaccaatcccgggttcaagcccgcctaggaagtgcggtccccgcctgaccgccccgggcttaagggagcctggctaggccggcagccggatggtcccgcagctcggggccggccatgcttcgcggtccgtggcgccagctttggctctttttcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggctggcgccttcctctgttgggccagcggtacctggacctcctgaccacgtggtactgcagcttcaaagactgctgccctagaggggattgcagaatctccaacaactttacaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcagtaatctcaggggcgatataatcaatgaggtggtcctaaagttgctcaaggctggatggtcccgggaagaaattacgatggaacacctggagccccacctccaggcggagattgtggagaccatagacaatggctttggccacagccgtcttgtgaaggaaaacctgattgactacttcatccccttcctgcctttggagtaccgtcacgtgaggctgtgtgcacgggatgccttcctgagccaggagctcctgtataaagaagagacactggatgaaatagcccagatgatggtgtatgtccccaaggaggaacaactcttttcttcccagggctgcaagtctatttcccagaggattaactacttcctgtcatgaaggctagaggaagacttcctggaactgcctttcttccactaacaggaccctgggacctgtaggagcaccccgtttgggactgtgaggtgtttgagggtgtggactggcatccagcagccactaacaaacacacaactggtgtgtaaaaggcaggccttacattagaagccaagccaatcctttttcttttttttggaggtcccaccgagatagataggaacttggattgctgaattcaaaaacagagcccattcttaagatcacttggtgccttaaagacacgcattccaaagtggaatgtggttgaagaaagtgggccaggtggttgaagaaagccatgtgggagctcagcaaatcccaagggcttattatgacactccagatggtctccttagcatctcagctcttctgcaaggaagagcttgggtgttaggcctcagaggctgtagggtccttgggttacagagccggggagaacgaagttctgtgacccaggggtggagaatacactctaggtttgcaggctggtgggctttcaaattggtacttccagaggaaagccaagctgcttctgttgtgagcgaatcagccaagagcctgaggctgaagggaaaagtacacagaggaagatattttacaaaccaggtcagtgtaggccaagacttatggtctacagattttggcgggggaggggggaccttttcaaagacaatagggggtcttgacatgtttgttgtatgtaaagatgataagattaaaatttttgattttcctaaaa

SEQ ID NO: 31804 - DNA, 730 bp, Homo sapiens
tgagattgcgccactgcactccagcctggtgacagagcaagactccatctcaaaaaaaaaaaaaaaaagaaagtagtccttgaatcccttctgctacaaagtctgccctctggcttcttattctaaggccaaacaggaggagtaactgattccacccgagagagattcagagttgcttggtttcttggctgttggctgttgtggtggatgggcctgtgtgtgccttttgctgtgactacctctttcctgtccttaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcagtaatctcaggggcgatataatcaatgagg

SEQ ID NO: 31805 - DNA, 4520 bp, Homo sapiens
agcagagagaacacacgtccttgcggaagtgacggcagttccgagtccagtgggggcggtgggagcgatgagggtctgagacggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggaggcaacttcccagccagaagacagtcgtggtggaagcagggaaaaagcagaaggccccaaagaagagaaaaaagaaagatcctaatgaacctcagaaaccagtttcagcatatgctttattctttcgtgatacacaggctgccatcaagggacagaatcctaatgccacttttggtgaggtttcaaaaattgtggcctccatgtgggatagtcttggagaggagcaaaaacaggtatataagaggaaaactgaggctgccaagaaagagtatctgaaggcactggctgcttacaaagacaaccaggagtgtcaggccactgtggaaacagtggaattggatccagcaccaccatcacaaactccttctccacctcctatggctactgttgacccagcatctccagcaccagcttcaatagagccccctgccctgtccccatccattgttgttaactccaccctttcatcctatgtggcaaaccaggcatcttctggagctgggggtcagcccaatatcaccaagttgattattaccaaacaaatgttgccctcttctattactatgtctcaaggagggatggttactgttatcccagccacagtggtgacctcccgggggctccaactaggccaaaccagtacagctactatccagcccagtcaacaagcccagattgtcactcggtcagtgttgcaggcagcagcagctgctgctgctgctgcttctatgcaactgcctccaccccgactacagccccctccattacaacagatgccacagcccccgactcagcagcaagttaccattctgcagcagcctcctccactccaggccatgcaacagcctccacctcagaaagttcgaatcaatttacagcaacagcctcctcctctgcagatcaagagtgtgcctctacccactttgaaaatgcagactaccttagtcccaccaactgtggaaagtagtcctgagcggcctatgaacaacagccctgaggcccatacagtggaggcaccttctcctgagactatctgtgagatgatcacagatgtagttcctgaggttgagtctccttctcagatggatgttgaattggtgagtgggtctcctgtggcactctcaccccagcctcgatgtgtgaggtctggttgtgagaaccctcccattgtgagtaaggactgggacaatgaatactgcagcaatgagtgtgtggtgaagcactgcagggatgtattcttggcctgggtagcctctagaaattcaaacacagtggtgtttgtgaaatagtccttcctgttctccaagccagtgaagagttatctgctgggaaagtgtccaagagcctgtttttgaaacacaagctgggcttctggtagtgcctcatcacaacccatgatggctgttcatgtttcaccccttttcttccttcagcagaggccaggctatggagcagggccactgaatttgctgtaatctggagatgctttttactttcaaccataagcggtaatagcagaggaaagggtgaagggagtctgggcaagcaaagcatagagatggtggggtggtggtggggttgaagaaacttgttggtataattgtcataggacttgcctaaaatattattaaaattacgggagtgtactcagctttgagcctaggagaaaatgccactgtgtgcatccattttaaagggttccctcataaaaaaatgttattccccattatcacatcagtacactgctttgaaaacaaaacttttcaacatgggcatactgggctacatggaaaatgacatcacccaggagtgatttctctttatatatattatttctgcagttaccatccttatctgagttatcacagttcatgaatctaagaggcggaactctacatcattagtaagaggttccaccaaagtctaaagttgtattcacttgtgtttgatgaactatctttaaaagaccataggtctatcattatttcttagacataatctaaagaaaaacagactagagaagccacctggttgtaacagaataagcagaagtttacagcatgatagtccaagtggtgataactttaaataaaactcaaatttttactgtttgtagacaggaatgctgtcctagagaacctcctcctcaaccagctacgtacatagttttatcctatgcattcctgttttctgtgttttttgttttttttttttgagacagagtctcgctctgtcacccaggctggagtgcagtggtgcgacctcagctcactgaaacctctgcctcccgggttcaagcgattctcctgcatcagcctcccgagtagctaggattacaggcgcccgccactacgcccagctaatttgtggtatttttagtagagacagggtttcaccatgttggccaggctggtctcgaactcctgacctcatgatccgcccgccttgacctcccaaagtgctgggattacaggcatgagccaccgcacccagcctgcattcctgtttttttaatggttttggagggtagcagtagagatggggtctcactatgttgcccagtctagtcttgaactcctgggctacagttaccctcctacctcggcttcccaaagtgctcggattacaggtgtgagccactgtgcctagcctataatgatcattttaatgtttcccatgcactcatttagtttgaaccttcacagcaacccaatgaggtaatactcccatttcacatataatactgagagatgagttgcacaagattatacactgttaagtagcagagccagaatggacttcagaatcccaactacaatacaaatgtttatttaaataaagaagaaagctattgtacaaatatcactcttcaggtttagcttacagagccatggctatggattcttagctctgtaaggaagtgcttctataaattcttaggtttagagatgataccatctgggtacctttgcttgaaccgtgcaaccacatctgggtctagtaggtggatcccatccagttggtttccaagggtgatcctgaaacagtgtaaaaggaggggcaaaccagaaatcctggaattagagggtttaatattgttaaaaaatgcataccaaatgaagactgcctatcatcatatcaaatatgccaattctaaaaagagcttaacattagaatagtatatggtagaattactagttcagaattggcatagattctggtgttaaaatagactggatctgtattatctgagggttagtaactaatgcttagccaggcctgcttcacagagttgctaccagggagtattctttggataagcaaaatgctagcagcatgtgttttaagctctgttaaggggtgaaagatgtaattattgacagattaaatagataacttcgtaaccaccagggggcagattcaatacatcacagaatggctgaggaagatccttgggttgtgaagagagtagaaaccctagggagcagtgcttttgggtcctagaacctgttgagtttctaatgaatatttgtagaatctcataaaacagtttaaatacaagcttaagtggcttatgaatcctgtgaagctcatttatggactagtgtaaaacaatgtgaagctctactaagttctgtccttaatcataaataatagccccttgaggactagcctgttctctggtcaccttaccagttgggttgcacattgtgtggtcgtccaaataactcaatcttgcgagtgccaggagatagtctttcaatcatgccatagatttcatctggtttatgactggtggaacgaacctaggaaataaaaactagctgctttttaagttac

SEQ ID NO: 31806 - DNA, 4697 bp, Homo sapiens
ccgcccccgccacccaatttgggagcttcgaatgcccgcccgagccttgaaggcgaaccacctgagggttacctgtgtctccgatgatgatatacttgaagagataagcataagtcatgggggcgatagcccagcgcctgactctctgcagccccacggcgctccttccaatcagcagagagaacacacgtccttgcggaagtgacggcagttccgagtccagtgggggcggtgggagcgatgagggtctgagacggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggaggcaacttcccagccagaagacagtcgtggtggaagcagggaaaaagcagaaggccccaaagaagagaaaaaagaaagatcctaatgaacctcagaaaccagtttcagcatatgctttattctttcgtgatacacaggctgccatcaagggacagaatcctaatgccacttttggtgaggtttcaaaaattgtggcctccatgtgggatagtcttggagaggagcaaaaacaggtatataagaggaaaactgaggctgccaagaaagagtatctgaaggcactggctgcttacaaagacaaccaggagtgtcaggccactgtggaaacagtggaattggatccagcaccaccatcacaaactccttctccacctcctatggctactgttgacccagcatctccagcaccagcttcaatagagccccctgccctgtccccatccattgttgttaactccaccctttcatcctatgtggcaaaccaggcatcttctggagctgggggtcagcccaatatcaccaagttgattattaccaaacaaatgttgccctcttctattactatgtctcaaggagggatggttactgttatcccagccacagtggtgacctcccgggggctccaactaggccaaaccagtacagctactatccagcccagtcaacaagcccagattgtcactcggtcagtgttgcaggcagcagcagctgctgctgctgctgcttctatgcaactgcctccaccccgactacagccccctccattacaacagatgccacagcccccgactcagcagcaagttaccattctgcagcagcctcctccactccaggccatgcaacagcctccacctcagaaagttcgaatcaatttacagcaacagcctcctcctctgcagatcaagagtgtgcctctacccactttgaaaatgcagactaccttagtcccaccaactgtggaaagtagtcctgagcggcctatgaacaacagccctgaggcccatacagtggaggcaccttctcctgagactatctgtgagatgatcacagatgtagttcctgaggttgagtctccttctcagatggatgttgaattggtgagtgggtctcctgtggcactctcaccccagcctcgatgtgtgaggtctggttgtgagaaccctcccattgtgagtaaggactgggacaatgaatactgcagcaatgagtgtgtggtgaagcactgcagggatgtattcttggcctgggtagcctctagaaattcaaacacagtggtgtttgtgaaatagtccttcctgttctccaagccagtgaagagttatctgctgggaaagtgtccaagagcctgtttttgaaacacaagctgggcttctggtagtgcctcatcacaacccatgatggctgttcatgtttcaccccttttcttccttcagcagaggccaggctatggagcagggccactgaatttgctgtaatctggagatgctttttactttcaaccataagcggtaatagcagaggaaagggtgaagggagtctgggcaagcaaagcatagagatggtggggtggtggtggggttgaagaaacttgttggtataattgtcataggacttgcctaaaatattattaaaattacgggagtgtactcagctttgagcctaggagaaaatgccactgtgtgcatccattttaaagggttccctcataaaaaaatgttattccccattatcacatcagtacactgctttgaaaacaaaacttttcaacatgggcatactgggctacatggaaaatgacatcacccaggagtgatttctctttatatatattatttctgcagttaccatccttatctgagttatcacagttcatgaatctaagaggcggaactctacatcattagtaagaggttccaccaaagtctaaagttgtattcacttgtgtttgatgaactatctttaaaagaccataggtctatcattatttcttagacataatctaaagaaaaacagactagagaagccacctggttgtaacagaataagcagaagtttacagcatgatagtccaagtggtgataactttaaataaaactcaaatttttactgtttgtagacaggaatgctgtcctagagaacctcctcctcaaccagctacgtacatagttttatcctatgcattcctgttttctgtgttttttgttttttttttttgagacagagtctcgctctgtcacccaggctggagtgcagtggtgcgacctcagctcactgaaacctctgcctcccgggttcaagcgattctcctgcatcagcctcccgagtagctaggattacaggcgcccgccactacgcccagctaatttgtggtatttttagtagagacagggtttcaccatgttggccaggctggtctcgaactcctgacctcatgatccgcccgccttgacctcccaaagtgctgggattacaggcatgagccaccgcacccagcctgcattcctgtttttttaatggttttggagggtagcagtagagatggggtctcactatgttgcccagtctagtcttgaactcctgggctacagttaccctcctacctcggcttcccaaagtgctcggattacaggtgtgagccactgtgcctagcctataatgatcattttaatgtttcccatgcactcatttagtttgaaccttcacagcaacccaatgaggtaatactcccatttcacatataatactgagagatgagttgcacaagattatacactgttaagtagcagagccagaatggacttcagaatcccaactacaatacaaatgtttatttaaataaagaagaaagctattgtacaaatatcactcttcaggtttagcttacagagccatggctatggattcttagctctgtaaggaagtgcttctataaattcttaggtttagagatgataccatctgggtacctttgcttgaaccgtgcaaccacatctgggtctagtaggtggatcccatccagttggtttccaagggtgatcctgaaacagtgtaaaaggaggggcaaaccagaaatcctggaattagagggtttaatattgttaaaaaatgcataccaaatgaagactgcctatcatcatatcaaatatgccaattctaaaaagagcttaacattagaatagtatatggtagaattactagttcagaattggcatagattctggtgttaaaatagactggatctgtattatctgagggttagtaactaatgcttagccaggcctgcttcacagagttgctaccagggagtattctttggataagcaaaatgctagcagcatgtgttttaagctctgttaaggggtgaaagatgtaattattgacagattaaatagataacttcgtaaccaccagggggcagattcaatacatcacagaatggctgaggaagatccttgggttgtgaagagagtagaaaccctagggagcagtgcttttgggtcctagaacctgttgagtttctaatgaatatttgtagaatctcataaaacagtttaaatacaagcttaagtggcttatgaatcctgtgaagctcatttatggactagtgtaaaacaatgtgaagctctactaagttctgtccttaatcataaataatagccccttgaggactagcctgttctctggtcaccttaccagttgggttgcacattgtgtggtcgtccaaataactcaatcttgcgagtgccaggagatagtctttcaatcatgccatagatttcatctggtttatgactggtggaacgaacctaggaaataaaaactagctgctttttaagttacacaa

SEQ ID NO: 31807 - DNA, 2017 bp, Homo sapiens
agtgggggcggtgggagcgatgagggtctgagacggtgggagcggttgtgtgaagatggagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggaggcaacttcccagccagaagacagtcgtggtggaagcagggaaaaagcagaaggccccaaagaagagaaaaaagaaagatcctaatgaacctcagaaaccagtttcagcatatgctttattctttcgtgatacacaggctgccatcaagggacagaatcctaatgccacttttggtgaggtttcaaaaattgtggcctccatgtgggatagtcttggagaggagcaaaaacaggtatataagaggaaaactgaggctgccaagaaagagtatctgaaggcactggctgcttacaaagacaaccaggagtgtcaggccactgtggaaacagtggaattggatccagcaccaccatcacaaactccttctccacctcctatggctactgttgacccagcatctccagcaccagcttcaatagagccccctgccctgtccccatccattgttgttaactccaccctttcatcctatgtggcaaaccaggcatcttctggagctgggggtcagcccaatatcaccaagttgattattaccaaacaaatgttgccctcttctattactatgtctcaaggagggatggttactgttatcccagccacagtggtgacctcccgggggctccaactaggccaaaccagtacagctactatccagcccagtcaacaagcccagattgtcactcggtcagtgttgcaggcagcagcagctgctgctgctgctgcttctatgcaactgcctccaccccgactacagccccctccattacaacagatgccacagcccccgactcagcagcaagttaccattctgcagcagcctcctccactccaggccatgcaacagcctccacctcagaaagttcgaatcaatttacagcaacagcctcctcctctgcagatcaagagtgtgcctctacccactttgaaaatgcagactaccttagtcccaccaactgtggaaagtagtcctgagcggcctatgaacaacagccctgaggcccatacagtggaggcaccttctcctgagactatctgtgagatgatcacagatgtagttcctgaggttgagtctccttctcagatggatgttgaattggtgagtgggtctcctgtggcactctcaccccagcctcgatgtgtgaggtctggttgtgagaaccctcccattgtgagtaaggactgggacaatgaatactgcagcaatgagtgtgtggtgaagcactgcagggatgtattcttggcctgggtagcctctagaaattcaaacacagtggtgtttgtgaaatagtccttcctgttctccaagccagtgaagagttatctgctgggaaagtgtccaagagcctgtttttgaaacacaagctgggcttctggtagtgcctcatcacaacccatgatggctgttcatgtttcaccccttttcttccttcagcagaggccaggctatggagca

SEQ ID NO: 31808 - DNA, 4201 bp, Homo sapiens
atgaggaatttgaaatcccacctatctccttggattctgatccctcattggctgtctcagatgtggttggccactttgatgacctggcagtttttcagcccagacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggaggcaacttcccagccagaagacagtcgtggtggaagcagggaaaaagcagaaggccccaaagaagagaaaaaagaaagatcctaatgaacctcagaaaccagtttcagcatatgctttattctttcgtgatacacaggctgccatcaagggacagaatcctaatgccacttttggtgaggtttcaaaaattgtggcctccatgtgggatagtcttggagaggagcaaaaacaggtatataagaggaaaactgaggctgccaagaaagagtatctgaaggcactggctgcttacaaagacaaccaggagtgtcaggccactgtggaaacagtggaattggatccagcaccaccatcacaaactccttctccacctcctatggctactgttgacccagcatctccagcaccagcttcaatagagccccctgccctgtccccatccattgttgttaactccaccctttcatcctatgtggcaaaccaggcatcttctggagctgggggtcagcccaatatcaccaagttgattattaccaaacaaatgttgccctcttctattactatgtctcaaggagggatggttactgttatcccagccacagtggtgacctcccgggggctccaactaggccaaaccagtacagctactatccagcccagtcaacaagcccagattgtcactcggtcagtgttgcaggcagcagcagctgctgctgctgctgcttctatgcaactgcctccaccccgactacagccccctccattacaacagatgccacagcccccgactcagcagcaagttaccattctgcagcagcctcctccactccaggccatgcaacagcctccacctcagaaagttcgaatcaatttacagcaacagcctcctcctctgcagatcaagagtgtgcctctacccactttgaaaatgcagactaccttagtcccaccaactgtggaaagtagtcctgagcggcctatgaacaacagccctgaggcccatacagtggaggcaccttctcctgagactatctgtgagatgatcacagatgtagttcctgaggttgagtctccttctcagatggatgttgaattggtgagtgggtctcctgtggcactctcaccccagcctcgatgtgtgaggtctggttgtgagaaccctcccattgtgagtaaggactgggacaatgaatactgcagcaatgagtgtgtggtgaagcactgcagggatgtattcttggcctgggtagcctctagaaattcaaacacagtggtgtttgtgaaatagtccttcctgttctccaagccagtgaagagttatctgctgggaaagtgtccaagagcctgtttttgaaacacaagctgggcttctggtagtgcctcatcacaacccatgatggctgttcatgtttcaccccttttcttccttcagcagaggccaggctatggagcagggccactgaatttgctgtaatctggagatgctttttactttcaaccataagcggtaatagcagaggaaagggtgaagggagtctgggcaagcaaagcatagagatggtggggtggtggtggggttgaagaaacttgttggtataattgtcataggacttgcctaaaatattattaaaattacgggagtgtactcagctttgagcctaggagaaaatgccactgtgtgcatccattttaaagggttccctcataaaaaaatgttattccccattatcacatcagtacactgctttgaaaacaaaacttttcaacatgggcatactgggctacatggaaaatgacatcacccaggagtgatttctctttatatatattatttctgcagttaccatccttatctgagttatcacagttcatgaatctaagaggcggaactctacatcattagtaagaggttccaccaaagtctaaagttgtattcacttgtgtttgatgaactatctttaaaagaccataggtctatcattatttcttagacataatctaaagaaaaacagactagagaagccacctggttgtaacagaataagcagaagtttacagcatgatagtccaagtggtgataactttaaataaaactcaaatttttactgtttgtagacaggaatgctgtcctagagaacctcctcctcaaccagctacgtacatagttttatcctatgcattcctgttttctgtgttttttgttttttttttttgagacagagtctcgctctgtcacccaggctggagtgcagtggtgcgacctcagctcactgaaacctctgcctcccgggttcaagcgattctcctgcatcagcctcccgagtagctaggattacaggcgcccgccactacgcccagctaatttgtggtatttttagtagagacagggtttcaccatgttggccaggctggtctcgaactcctgacctcatgatccgcccgccttgacctcccaaagtgctgggattacaggcatgagccaccgcacccagcctgcattcctgtttttttaatggttttggagggtagcagtagagatggggtctcactatgttgcccagtctagtcttgaactcctgggctacagttaccctcctacctcggcttcccaaagtgctcggattacaggtgtgagccactgtgcctagcctataatgatcattttaatgtttcccatgcactcatttagtttgaaccttcacagcaacccaatgaggtaatactcccatttcacatataatactgagagatgagttgcacaagattatacactgttaagtagcagagccagaatggacttcagaatcccaactacaatacaaatgtttatttaaataaagaagaaagctattgtacaaatatcactcttcaggtttagcttacagagccatggctatggattcttagctctgtaaggaagtgcttctataaattcttaggtttagagatgataccatctgggtacctttgcttgaaccgtgcaaccacatctgggtctagtaggtggatcccatccagttggtttccaagggtgatcctgaaacagtgtaaaaggaggggcaaaccagaaatcctggaattagagggtttaatattgttaaaaaatgcataccaaatgaagactgcctatcatcatatcaaatatgccaattctaaaaagagcttaacattagaatagtatatggtagaattactagttcagaattggcatagattctggtgttaaaatagactggatctgtattatctgagggttagtaactaatgcttagccaggcctgcttcacagagttgctaccagggagtattctttggataagcaaaatgctagcagcatgtgttttaagctctgttaaggggtgaaagatgtaattattgacagattaaatagataacttcgtaaccaccagggggcagattcaatacatcacagaatggctgaggaagatccttgggttgtgaagagagtagaaaccctagggagcagtgcttttgggtcctagaacctgttgagtttctaatgaatatttgtagaatctcataaaacagtttaaatacaagcttaagtggcttatgaatcctgtgaagctcatttatggactagtgtaaaacaatgtgaagctctactaagttctgtccttaatcataaataatagccccttgaggactagcctgttctctggtcaccttaccagttgggttgcacattgtgtggtcgtccaaataactcaatcttgcgagtgccaggagatagtctttcaatcatgccatagatttcatctggtttatgactggtggaacgaacctaggaaataaaaactagctgctttttaagttac

SEQ ID NO: 31809 - DNA, 1020 bp, Homo sapiens
atgatgcccttttgccacaatataattaatatttcctgtgtgaaaaacaactggtcaaatgatgtccgtgcttccctgtacagtttaatggtgctcataattctgaccacactcgttggcaatctgatagttattgtttctatatcacacttcaaacaacttcataccccaacaaattggctcattcattccatggccactgtggactttcttctggggtgtctggtcatgccttacagtatggtgagatctgctgagcactgttggtattttggagaagtcttctgtaaaattcacacaagcaccgacattatgctgagctcagcctccattttccatttgtctttcatctccattgaccgctactatgctgtgtgtgatccactgagatataaagccaagatgaatatcttggttatttgtgtgatgatcttcattagttggagtgtccctgctgtttttgcatttggaatgatctttctggagctaaacttcaaaggcgctgaagagatatattacaaacatgttcactgcagaggaggttgctctgtcttctttagcaaaatatctggggtactgacctttatgacttctttttatatacctggatctattatgttatgtgtctattacagaatatatcttatcgctaaagaacaggcaagattaattagtgatgccaatcagaagctccaaattggattggaaatgaaaaatggaatttcacaaagcaaagaaaggaaagctgtgaagacattggggattgtgatgggagttttcctaatatgctggtgccctttctttatctgtacagtcatggacccttttcttcactacattattccacctactttgaatgatgtattgatttggtttggctacttgaactctacatttaatccaatggtttatgcatttttctatccttggtttagaaaagcactgaagatgatgctgtttggtaaaattttccaaaaagattcatccaggtgtaaattatttttggaattgagttcatag

SEQ ID NO: 31810 - DNA, 1157 bp, Homo sapiens
tgacaaaattctatctgttcttgttttttgaaggaaaaattcaattgctctgaatatggaaatagatcttgcccagaaaatgaaagatctctgggtgtccgagtggctatgtattcatttatggcaggatccatattcatcacaatatttggcaatcttgccatgataatttccatttcctacttcaagcagcttcacacaccaaccaacttcctcatcctctccatggccatcactgatttcctcctgggattcaccatcatgccatatagtatgatcagatcggtggagaactgctggtattttgggcttacattttgcaagatttattatagttttgacctgatgcttagcataacatccatttttcatctttgctcagtggccattgatagattttatgctatatgttacccattactttattccaccaaaataactattccagtcattaaaagattgctacttctatgttggtcggtccctggagcatttgccttcggggtggtcttctcagaggcctatgcagatggaatagagggctatgacatcttggttgcttgttccagttcctgcccagtgatgttcaacaagctatgggggaccaccttgtttatggcaggtttcttcactcctgggtctatgatggtggggatttatggcaaaatttttgcagtatccagaaaacatgctcatgccatcaataacttgcgagaaaatcaaaataatcaagtgaagaaagacaaaaaagctgccaaaactttaggaatagtgataggagttttcttattatgttggtttccttgtttcttcacaattttattggatccctttttgaacttctctactcctgtagttttgtttgatgccttgacatggtttggctattttaactccacatgtaatccgttaatatatggtttcttctatccctggtttcgcagagcactgaagtacattttgctaggtaaaattttcagctcatgtttccataatactattttgtgtatgcaaaaagaaagtgagtaggctttttctgcatgaataaattgaagcaaaaaactagaatttagaagaatgaagttgtttaagatgtgtgtttttgtgcatgtgtgtattattttagctaccatagaaagctgttggtttctaagacg

SEQ ID NO: 31811 - DNA, 1056 bp, Homo sapiens
atggctgtctcatcagagcaacatgaactttcacatttcaaaagaacacagacaaaaaaggaaaaattcaattgctctgaatatggaaatagatcttgcccagaaaatgaaagatctctgggtgtccgagtggctatgtattcatttatggcaggatccatattcatcacaatatttggcaatcttgccatgataatttccatttcctacttcaagcagcttcacacaccaaccaacttcctcatcctctccatggccatcactgatttcctcctgggattcaccatcatgccatatagtatgatcagatcggtggagaactgctggtattttgggcttacattttgcaagatttattatagttttgacctgatgcttagcataacatccatttttcatctttgctcagtggccattgatagattttatgctatatgttacccattactttattccaccaaaataactattccagtcattaaaagattgctacttctatgttggtcggtccctggagcatttgccttcggggtggtcttctcagaggcctatgcagatggaatagagggctatgacatcttggttgcttgttccagttcctgcccagtgatgttcaacaagctatgggggaccaccttgtttatggcaggtttcttcactcctgggtctatgatggtggggatttatggcaaaatttttgcagtatccagaaaacatgctcatgccatcaataacttgcgagaaaatcaaaataatcaagtgaagaaagacaaaaaagctgccaaaactttaggaatagtgataggagttttcttattatgttggtttccttgtttcttcacaattttattggatccctttttgaacttctctactcctgtagttttgtttgatgccttgacatggtttggctattttaactccacatgtaatccgttaatatatggtttcttctatccctggtttcgcagagcactgaagtacattttgctaggtaaaattttcagctcatgtttccataatactattttgtgtatgcaaaaagaaagtgagtag

SEQ ID NO: 31812 - DNA, 1056 bp, Homo sapiens; identical to SEQ ID NO: 31811

SEQ ID NO: 31813 - DNA, 1038 bp, Homo sapiens
atgagcagcaattcatccctgctggtggctgtgcagctgtgctacgcgaacgtgaatgggtcctgtgtgaaaatccccttctcgccgggatcccgggtgattctgtacatagtgtttggctttggggctgtgctggctgtgtttggaaacctcctggtgatgatttcaatcctccatttcaagcagctgcactctccgaccaattttctcgttgcctctctggcctgcgctgatttcttggtgggtgtgactgtgatgcccttcagcatggtcaggacggtggagagctgctggtattttgggaggagtttttgtactttccacacctgctgtgatgtggcattttgttactcttctctctttcacttgtgcttcatctccatcgacaggtacattgcggttactgaccccctggtctatcctaccaagttcaccgtatctgtgtcaggaatttgcatcagcgtgtcctggatcctgcccctcatgtacagcggtgctgtgttctacacaggtgtctatgacgatgggctggaggaattatctgatgccctaaactgtataggaggttgtcagaccgttgtaaatcaaaactgggtgttgacagattttctatccttctttatacctacctttattatgataattctgtatggtaacatatttcttgtggctagacgacaggcgaaaaagatagaaaatactggtagcaagacagaatcatcctcagagagttacaaagccagagtggccaggagagagagaaaagcagctaaaaccctgggggtcacagtggtagcatttatgatttcatggttaccatatagcattgattcattaattgatgcctttatgggctttataacccctgcctgtatttatgagatttgctgttggtgtgcttattataactcagccatgaatcctttgatttatgctttattttacccatggtttaggaaagcaataaaagttattgtaactggtcaggttttaaagaacagttcagcaaccatgaatttgttttctgaacatatataa

SEQ ID NO: 31814 - DNA, 954 bp, Homo sapiens
gtgaatgggtcctgtgtgaaaatccccttctcgccgggatcccgggtgattctgtacatagtgtttggctttggggctgtgctggctgtgtttggaaacctcctggtgatgatttcaatcctccatttcaagcagctgcactctccgaccaattttctcgttgcctctctggcctgcgctgatttcttggtgggtgtgactgtgatgcccttcagcatggtcaggacggtggagagctgctggtattttgggaggagtttttgtactttccacacctgctgtgatgtggcattttgttactcttctctctttcacttgtgcttcatctccatcgacaggtacattgcggttactgaccccctggtctatcctaccaagttcaccgtatctgtgtcaggaatttgcatcagcgtgtcctggatcctgcccctcatgtacagcggtgctgtgttctacacaggtgtctatgacgatgggctggaggaattatctgatgccctaaactgtataggaggttgtcagaccgttgtaaatcaaaactgggtgttgacagattttctatccttctttatacctacctttattatgataattctgtatggtaacatatttcttgtggctagacgacaggcgaaaaagatagaaaatactgagagttacaaagccagagtggccaggagagagagaaaagcagctaaaaccctgggggtcacagtggtagcatttatgatttcatggttaccatatagcattgattcattaattgatgcctttatgggctttataacccctgcctgtatttatgagatttgctgttggtgtgcttattataactcagccatgaatcctttgatttatgctttattttacccatggtttaggaaagcaataaaagttattgtaactggtcaggttttaaagaacagttcagcaaccatgaatttgttttctgaa

SEQ ID NO: 31815 - DNA, 2026 bp, Homo sapiens
aggaagtcgtgctgcggagccaaatttgaagcaagcggaggcgcgggggcgcgtctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtgcctaattcagtggtttgagacagcaccaagtcggacctgcccacagtgccgaatccaggttggcaaaagaaccattatcaataagctcttctttgatcttgcccaggaggaggagaatgtcttggatgcagaattcttaaagaatgaactggacaatgtcagagcccagctttcccagaaagacaaggagaaacgagacagccaggtcatcatcgacactctgcgggatacgctggaagaacgcaatgctactgtggtatctctgcagcaggccttgggcaaggccgagatgctgtgctccacactgaaaaagcagatgaagtacttagagcagcagcaggatgagaccaaacaagcacaagaggaggcccgccggctcaggagcaagatgaagaccatggagcagattgagcttctactccagagccagcgccctgaggtggaggagatgatccgagacatgggtgtgggacagtcagcggtggaacagctggctgtgtactgtgtgtctctcaagaaagagtacgagaatctaaaagaggcacggaaggcctcaggggaggtggctgacaagctgaggaaggatttgttttcctccagaagcaagttgcagacagtctactctgaattggatcaggccaagttagaactgaagtcagcccagaaggacttacagagtgctgacaaggaaatcatgagcctgaaaaagaagctaacgatgctgcaggaaaccttgaacctgccaccagtggccagtgagactgtcgaccgcctggttttagagagcccagcccctgtggaggtgaatctgaagctccgccggccatccttccgtgatgatattgatctcaatgctacctttgatgtggatactcccccagcccggccctccagctcccagcatggttactacgaaaaactttgcctagagaagtcacactccccaattcaggatgtccccaagaagatatgcaaaggccccaggaaggagtcccagctctcactgggtggccagagctgtgcaggagagccagatgaggaactggttggtgccttccctatttttgtccggaatgccatcctaggccagaaacagcccaagaggcccaggtcagagtcctcttgcagcaaagatgtggtaaggacaggcttcgatgggctcggtggccggacaaaattcatccagcctactgacacagtcatgatccgcccattgcctgttaagcccaagaccaaggttaagcagagggtgagggtgaagacagtgccttctctcttccaggccaagctggacaccttcctgtggtcgtgagaacagtgagtctgaccaatggccagacacatgcctgcaacttgtaggtcaaggactgtccaggcaggggttttgtggacagagccccactttcgggaccagcctgaggtgtaagggcagacaaacaggtgagggtgagtgtggcacccagagactgctcttcctgccctcaccctgccccactcctacgactgggagctgacatgaccagcccactgatcctgtcagcaggtcctgctcctgttgccaggctcctgtttatagccatgatcagatgtggtcagactctttctgggcctggagaccacggtcacttgttgactgtctctgtggaccagagtgcttgaggcatctcaggcagcctcagcccaagcttctacctgcctttgacttgcttctaggcatagcctgggccaagcagggtggggaatggaggatagcatgggatgtatggagaggatggaagattttcatgtaaaataaaattaaaaaaaaaaaacaa

SEQ ID NO: 31816 - DNA, 4059 bp, Homo sapiens
atggcgagcgactccccggctcgaagcctggatgaaatagatctctcggctctgagggaccccgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgctcccccatgagcctgcgaaggtgaaaccagaagaatccagggacattacccggcccagtcgaccagctgatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaa

SEQ ID NO: 31817 - DNA, 4727 bp, Homo sapiens
attataacagccaatgcagccgccatccacgcacaagcaaagaagcatgtcccatttaaatacacccacgcagccccagcgcccttagccgatcggggcgctcagcccacacgcaccgctgctcggggcttggagatccgcgcaggctgggctcccggacccggcggaccgacgcgcggaggatcgggatccggcgctgtggggctggggtgggcgggggaggctgggcccggggcctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccccgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgctcccccatgagcctgcgaaggtgaaaccagaagaatccagggacattacccggcccagtcgaccagctagctacaaaaaagctatagatgaggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttg

SEQ ID NO: 31818 - DNA, 3996 bp, Homo sapiens
atggcgagcgactccccggctcgaagcctggatgaaatagatctctcggctctgagggaccccgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgctcccccatgagcctgcgaaggtgaaaccagaagaatccagggacattacccggcccagtcgaccagctagctacaaaaaagctatagatgaggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaa

SEQ ID NO: 31819 - DNA, 5740 bp, Homo sapiens
attataacagccaatgcagccgccatccacgcacaagcaaagaagcatgtcccatttaaatacacccacgcagccccagcgcccttagccgatcggggcgctcagcccacacgcaccgctgctcggggcttggagatccgcgcaggctgggctcccggacccggcggaccgacgcgcggaggatcgggatccggcgctgtggggctggggtgggcgggggaggctgggcccggggcctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccccgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaaatagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgctcccccatgagcctgcgaaggtgaaaccagaagaatccagggacattacccggcccagtcgaccagctgtgagtgcttttctctccaagagttttgaactcttaatttaccaggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttt

SEQ ID NO: 31820 - DNA, 6970 bp, Homo sapiens
attataacagccaatgcagccgccatccacgcacaagcaaagaagcatgtcccatttaaatacacccacgcagccccagcgcccttagccgatcggggcgctcagcccacacgcaccgctgctcggggcttggagatccgcgcaggctgggctcccggacccggcggaccgacgcgcggaggatcgggatccggcgctgtggggctggggtgggcgggggaggctgggcccggggcctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccccgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgctcccccatgagcctgcgaaggtgaaaccagaagaatccagggacattacccggcccagtcgaccagctagctacaaaaaagctatagatgaggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttttatgcgactgggattttttttttccaaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattaggaaaatggagccatttcaatctagtggtttgggcaagatggggaagagaaggggaaacattctagtttctggattacattattatgcccctcctgaaaaggtggttgtcatttgcatttatttaaagcaggtaatatgcaggaatgtaactgaggattatcttcaggcaatcagcaagatatcctcctcatggtccctttagctctcaaaagcaatgaaatcctcctgttctcatttttactgctgtggttgtgctgctgaacaatactatcttctcaaattccatgccacaaattcagcaataactttttggattgaatttaacaactactgtaattggatgctgatgtggacaaaatatattgatttcgatttcactcccgaatgtgattgccaccagctctttatattgctgctgtggtattttaaaccagaagcttctttaaattatgttgcaaactgatctttgtttttatgttttgttttgtttttatttctaagtgataagtttgaaacacacagctttaaatgatttttttattgtgggattttgggtacagttaagaaataaaagggaatcattgtgtttaaacataaggtagtttgtgaatgtattttttaaaatctagagtcattgaaacaaatcataagaaaacaatattaatgcagtcttgtttacagtatgtacagtgacataacatagaacatgagcttttctggtgccaacaacaataaaacacacgttaaacatcaa

SEQ ID NO: 31821 - DNA, 3894 bp, Homo sapiens
atggcgagcgactccccggctcgaagcctggatgaaatagatctctcggctctgagggaccccgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgctcccccatgagcctgcgaaggtgaaaccagaagaatccagggacattacccggcccagtcgaccagctgatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaa

SEQ ID NO: 31822 - DNA, 3972 bp, Homo sapiens
atggcgagcgactccccggctcgaagcctggatgaaatagatctctcggctctgagggaccccgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgctcccccatgagcctgcgaaggtgaaaccagaagaatccagggacattacccggcccagtcgaccagctgatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaa

SEQ ID NO: 31823 - DNA, 3807 bp, Homo sapiens
atggcgagcgactccccggctcgaagcctggatgaaatagatctctcggctctgagggaccccgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgctcccccatgagcctgcgaaggtgaaaccagaagaatccagggacattacccggcccagtcgaccagctgatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaa

SEQ ID NO: 31824 - DNA, 3918 bp, Homo sapiens
atggcgagcgactccccggctcgaagcctggatgaaatagatctctcggctctgagggaccccgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgctcccccatgagcctgcgaaggtgaaaccagaagaatccagggacattacccggcccagtcgaccagctagctacaaaaaagctatagatgaggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaa

SEQ ID NO: 31825 - DNA, 5662 bp, Homo sapiens
attataacagccaatgcagccgccatccacgcacaagcaaagaagcatgtcccatttaaatacacccacgcagccccagcgcccttagccgatcggggcgctcagcccacacgcaccgctgctcggggcttggagatccgcgcaggctgggctcccggacccggcggaccgacgcgcggaggatcgggatccggcgctgtggggctggggtgggcgggggaggctgggcccggggcctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccccgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaaatagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgctcccccatgagcctgcgaaggtgaaaccagaagaatccagggacattacccggcccagtcgaccagctgtgagtgcttttctctccaagagttttgaactcttaatttaccaggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttt

SEQ ID NO: 31826 - DNA, 2785 bp, Homo sapiens
cggcaatgctgatgttttaagcagttagaggaggtggaagaagctcgactccctcttcttccccattatctgcccacaatcccctcctttggagctgctaatgattactaattcttaacattcgagttcaatctcctcccggagacaccctcccaggcgagggcactgcgactacactgaggttctgcccactcctgggcagcttcttagctgggtggcgaaaacaaaaatgccgcctaattggtcactggccctttctcatgaatgaaggaggtttctgttttaagaaataaagtgactcctcagccgttgattcactgcccacagggagattttgagcagaggcttcctaggctccgtagaaatttgcatacagcttccacttcctgcttcagagcctgttcttctacttacctgggcccggagaaggtggagggagacgagaagccgccgagagccgactaccctccgggcccagtctgtctgtccgtggtggatctaagcctcatctgtatcctcttgtgatggcgtgaaggaaagccatggcagatttccagcctggtgatgctgtacagaacacaggtggcctgcttccatgcctcctcagcttcaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccacgaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgtaa

SEQ ID NO: 31827 - DNA, 2264 bp, Homo sapiens
tacttacctgggcccggagaaggtggagggagacgagaagccgccgagagccgactaccctccgggcccagtctgtctgtccgtggtggatctaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccacgaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgtaa

SEQ ID NO: 31828 - DNA, 5128 bp, Homo sapiens
ggtggaagaagctcgactccctcttcttccccattatctgcccacaatcccctcctttggagctgctaatgattactaattcttaacattcgagttcaatctcctcccggagacaccctcccaggcgagggcactgcgactacactgaggttctgcccactcctgggcagcttcttagctgggtggcgaaaacaaaaatgccgcctaattggtcactggccctttctcatgaatgaaggaggtttctgttttaagaaataaagtgactcctcagccgttgattcactgcccacagggagattttgagcagaggcttcctaggctccgtagaaatttgcatacagcttccacttcctgcttcagagcctgttcttctacttacctgggcccggagaaggtggagggagacgagaagccgccgagagccgactaccctccgggcccagtctgtctgtccgtggtggatctaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccacgaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgtaagattatgttttacttatctcaaaggagatacatataatttataatgatatgggcagttgcttccagggacatcaacaaagctgcttagatataatattagataaatataacagaccactctgtattaatggattaaagccagctagttaaacaaccctttttaaccataatcatggaagctttattcttgcaataaagatttttaggctgggcgcagtgactcacacctgtaatcccagcactttgggaagctaaggcaggcagatcatttgaggtcaggagtttgagaccagcctggccaacatggtgaaaccccatctctgctaaaattacaaaaaagttagccgggcatggtggtgtgcacctgtaatcccagctactcgggaggctgaggcaggagaatcacttgaacccgggaggcagaggttgcagtgagccgagatcatgtcactgcactctagcttgggagacagagcgagactccgtctcaaaaaacaaacaaacaaataaaaacacccatttttaacaaaacaactttatatagcatacagccatgattctaaatagtatgattatggttctcaggatctgactacataggtaaaaatatttgcatatgtgtatgaagtgttgggggatgtaggctagaattgtagtctgtgttctaattttggttctaccaccaattagctgtatgacctttagcaagtcctttaacttttcttagattccagggactcatttataaaatgacatggacaaaagcatctctaatcactctaaaagatttgaagtctaggacctaaattctaaatactcttttgaggagtgactgagttttcattttcataattatgtctctcagaggacaaatttacattttcttaacagagacattttcttcttctttttttttgtttgagacagagtctcgctctgtcgtccaggctggagtgcagtgctgcaatcttggctcactgcaacctgcgcctcctgggttcaagtgattcttctgcctcaacctcccaagtagctagacctataggcgcctgccaccatgcccagctaatttttgtatttttagtagagacagggtttcatattggccagactggtctcgaactcctgaccttgtgatccgcccacctcggcctcccaaagtgctgggattacaggtgtgagccaccacacccagccaacattttcctcttttaaaaaatatcttctcacgcctgtaatcccagcactttgggaggctgaggcaggcggatcatgaggtcaggagatcaagaccatcctggctaacacggtgaaactccatctctactaaaaatacaaaaaaaatagccgggcgtggtggcaggcgcctgtagtcccagctactggggaggctgaggcaggaaaatggtgtcaacccgggaggcggagcttgcagtgagccgagattgcgccactgcactccagcctgggcaatagagtgagactccgtctcaaaaaaaaaaaaaaaaaaaaaaacttcaacaataccctcaggttgataattttggatatctatctgtatctatatatcttgtttacctggtctccagaaaaagaacacatacacatatccatatataaaatatgtatacatgtatcaaatctacgtaaactataaaggtgggatggctttaattatggcccaagctactaagacaatgaagactttttggggctgcaagctactgcttcccttctttatctactagcctcttaaacaaggctcacttgtgctacaagacagtccaccgttttgttttttttttcttttttttgagacagggtctcactctttcccaggctgcagtacagtgacacagtctcagctcactgcagctttgaccttgccgggctcaggtgacccttacacttcagcctcccaagtagcagggactataggtgtgcaccaacatgcttggttaatttttgtattttttgtagagacagggttttgccatgttgtccaggctagtctcgaattcctgggctcaagtgattcacctgccttggcctcccaaagtgctaggattacagatgggagccaccacgcccagcccagtccagctcttatatgtagcacagggaaaggacaaatacttgtcaactataaataagaaacattgctaatgcattgcaaagaacactagtttcatttactttataacttagatgtctactgggtgagacgaatgtctttgttctttaaaaaataggaaaagagaagaaaaactagcataacataagtactcatttgtaagactttctgacatgtaacattagttccgtagttttgagacctggtagaactgactttcatatttggataacctggaaaacacccaaacacaaacttcaagtcttctttctcttttttcattatcttttttagtctgaggtgacaccatcattaaggattcgacacccgtttgtaaataaaatgacatcag

SEQ ID NO: 31829 - DNA, 4676 bp, Homo sapiens
atggctcctcagctagaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccacgaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgtaagattatgttttacttatctcaaaggagatacatataatttataatgatatgggcagttgcttccagggacatcaacaaagctgcttagatataatattagataaatataacagaccactctgtattaatggattaaagccagctagttaaacaaccctttttaaccataatcatggaagctttattcttgcaataaagatttttaggctgggcgcagtgactcacacctgtaatcccagcactttgggaagctaaggcaggcagatcatttgaggtcaggagtttgagaccagcctggccaacatggtgaaaccccatctctgctaaaattacaaaaaagttagccgggcatggtggtgtgcacctgtaatcccagctactcgggaggctgaggcaggagaatcacttgaacccgggaggcagaggttgcagtgagccgagatcatgtcactgcactctagcttgggagacagagcgagactccgtctcaaaaaacaaacaaacaaataaaaacacccatttttaacaaaacaactttatatagcatacagccatgattctaaatagtatgattatggttctcaggatctgactacataggtaaaaatatttgcatatgtgtatgaagtgttgggggatgtaggctagaattgtagtctgtgttctaattttggttctaccaccaattagctgtatgacctttagcaagtcctttaacttttcttagattccagggactcatttataaaatgacatggacaaaagcatctctaatcactctaaaagatttgaagtctaggacctaaattctaaatactcttttgaggagtgactgagttttcattttcataattatgtctctcagaggacaaatttacattttcttaacagagacattttcttcttctttttttttgtttgagacagagtctcgctctgtcgtccaggctggagtgcagtgctgcaatcttggctcactgcaacctgcgcctcctgggttcaagtgattcttctgcctcaacctcccaagtagctagacctataggcgcctgccaccatgcccagctaatttttgtatttttagtagagacagggtttcatattggccagactggtctcgaactcctgaccttgtgatccgcccacctcggcctcccaaagtgctgggattacaggtgtgagccaccacacccagccaacattttcctcttttaaaaaatatcttctcacgcctgtaatcccagcactttgggaggctgaggcaggcggatcatgaggtcaggagatcaagaccatcctggctaacacggtgaaactccatctctactaaaaatacaaaaaaaatagccgggcgtggtggcaggcgcctgtagtcccagctactggggaggctgaggcaggaaaatggtgtcaacccgggaggcggagcttgcagtgagccgagattgcgccactgcactccagcctgggcaatagagtgagactccgtctcaaaaaaaaaaaaaaaaaaaaaaacttcaacaataccctcaggttgataattttggatatctatctgtatctatatatcttgtttacctggtctccagaaaaagaacacatacacatatccatatataaaatatgtatacatgtatcaaatctacgtaaactataaaggtgggatggctttaattatggcccaagctactaagacaatgaagactttttggggctgcaagctactgcttcccttctttatctactagcctcttaaacaaggctcacttgtgctacaagacagtccaccgttttgttttttttttcttttttttgagacagggtctcactctttcccaggctgcagtacagtgacacagtctcagctcactgcagctttgaccttgccgggctcaggtgacccttacacttcagcctcccaagtagcagggactataggtgtgcaccaacatgcttggttaatttttgtattttttgtagagacagggttttgccatgttgtccaggctagtctcgaattcctgggctcaagtgattcacctgccttggcctcccaaagtgctaggattacagatgggagccaccacgcccagcccagtccagctcttatatgtagcacagggaaaggacaaatacttgtcaactataaataagaaacattgctaatgcattgcaaagaacactagtttcatttactttataacttagatgtctactgggtgagacgaatgtctttgttctttaaaaaataggaaaagagaagaaaaactagcataacataagtactcatttgtaagactttctgacatgtaacattagttccgtagttttgagacctggtagaactgactttcatatttggataacctggaaaacacccaaacacaaacttcaagtcttctttctcttttttcattatcttttttagtctgaggtgacaccatcattaaggattcgacacccgtttgtaaataaaatgacatcag

SEQ ID NO: 31830 - DNA, 2778 bp, Homo sapiens
gctgatgttttaagcagttagaggaggtggaagaagctcgactccctcttcttccccattatctgcccacaatcccctcctttggagctgctaatgattactaattcttaacattcgagttcaatctcctcccggagacaccctcccaggcgagggcactgcgactacactgaggttctgcccactcctgggcagcttcttagctgggtggcgaaaacaaaaatgccgcctaattggtcactggccctttctcatgaatgaaggaggtttctgttttaagaaataaagtgactcctcagccgttgattcactgcccacagggagattttgagcagaggcttcctaggctccgtagaaatttgcatacagcttccacttcctgcttcagagcctgttcttctacttacctgggcccggagaaggtggagggagacgagaagccgccgagagccgactaccctccgggcccagtctgtctgtccgtggtggatctaagcctcatctgtatcctcttgtgatggcgtgaaggaaagccatggcagatttccagcctggtgatgctgtacagaacacaggtggcctgcttccatgcctcctcagcttcaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccacgaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgtaa

SEQ ID NO: 31831 - DNA, 903 bp, Homo sapiens
ataggaaagaaggaaatgaaggcggagagtggggagagagcagcagaattcaatttaatctgaggccaccccaagtgttttgtagaattgggctgaagaggtttcctaggcagcctcgcaggctgcacagcacaccacccccgagaagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcaga

SEQ ID NO: 31832 - DNA, 1767 bp, Homo sapiens
atgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccagcaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaagatcaggctttgcccgtgtggagtccaaagtccttccctaacgaagtggagcctgagggtacagggaaggagaaagactgggatctcagagaccagctgcaaaagaagactttgcagctccaggccaaggaaaaggagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgttcctc

SEQ ID NO: 31833 - DNA, 1065 bp, Homo sapiens
gagatgacagcgcagcggggattggctgaagccctaagcaacctctactagagcagagagatgagctgtgggctggtgcttctgtggtgaggtggtggtgtttctggagagcagatcagaggcaggggaaaaccacgcagaagcaggagctgaagacctcagaccggcaccagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccagcaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaaggtcagcaaatttattaccacaaattctaagatattgctcttctcttacctgcctagaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactcagg

SEQ ID NO: 31834 - DNA, 2331 bp, Homo sapiens
agagaattccagactgagccagagtagcgaagtcccagtaaaggggcagagagtctgctacctgttgagtctgtttggcctataaataaaccccaaggggttagagctagcaaatgcctgctagttggtgaagctgagataccctcctcccagggtggtgggtaatgaggtcgtgggaggaagagaagcagcagcagctgtgagggggagtccctcttccttcatcagtccctggtctgactccagtgatcagaggaggcaggacacagaatttccaacgctcaggatccagctcatccaaatccagcccaactcagcaaagtgaccagagggttctaggaggataaactacagaagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccagcaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaagatcaggctttgcccgtgtggagtccaaagtccttccctaacgaagtggagcctgagggtacagggaaggagaaagactgggatctcagagaccagctgcaaaagaagactttgcagctccaggccaaggaaaaggagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgacc

SEQ ID NO: 31835 - DNA, 2243 bp, Homo sapiens
acttagatgataccagagagcaagagagaggaactggggtttgcgaaccttgtggctttgtctgtttcctgtttcagcaaggctgctgtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccagcaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaagatcaggctttgcccgtgtggagtccaaagtccttccctaacgaagtggagcctgagggtacagggaaggagaaagactgggatctcagagaccagctgcaaaagaagactttgcagctccaggccaaggaaaaggagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgtt

SEQ ID NO: 31836 - DNA, 2058 bp, Homo sapiens
gcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccagcaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaagatcaggctttgcccgtgtggagtccaaagtccttccctaacgaagtggagcctgagggtacagggaaggagaaagactgggatctcagagaccagctgcaaaagaagactttgcagctccaggccaaggaaaaggagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgttcctca

SEQ ID NO: 31837 - DNA, 1854 bp, Homo sapiens
tcagagttcaggggcccacttagatgataccagagagcaagagagaggaactggggtttgcgaaccttgtggctttgtctgtttcctgtttcagcaaggctgctgtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccagcaactgcaggccaagattgaatgcctgcaaggggacagagacctgtgcagcttggatacccaggacctacaagatcaactaaaaaggtcagaggcagagaaactcaccctggtgaccagagtacagcagttgcaggaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactcag

SEQ ID NO: 31838 - DNA, 1303 bp, Homo sapiens
gtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagctagaggagaagggcaaagcgcagcatccccaggccagggagcaagggccctccaggcggccaggacaggtgactgtcctcaaggaacccttgtcttgtgccagaaggatttcttctcccagagagcaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacaggtatggggatgccacatagacatggggctggggactccaggcagcttggggaacaaggggagccagctgcacaactccctggagccctctcctctctgatctccct

SEQ ID NO: 31839 - DNA, 540 bp, Homo sapiens
gtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagtccctggtctgactccagtgatcagaggaggcaggacacagaatttccaacgctcaggatccagctcatccaaatccagcccaactcagcaaagtgaccagagggttctaggaggataaactacagaagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcagg

SEQ ID NO: 31840 - DNA, 3260 bp, Homo sapiens
attcagggctgctgtccagtgctgctttattggcagtgctgccagggtctccgttagctctctgcaaattgccttcctttctgctcctcctactccctccttcccccatagaatttttcttttcattgcccactttactgttttggctccagactgtcgttaagaatgtacagcctaattctggtgtgtttcgggatattcttctgtccagtattctggaagggcggggaggcatggcagcgttttacttgacgttgatggtgctgtgaagtccattctttcctctgcaagactactgactatgcagaaatttatcgaagcggattattatgaactagactggtattatgaagaatgctcggatgttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcactgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggtgatcacgcggggcctcggcccctctctgtcctcctgggggactccctttggtccctgatccacctgcggaaggcggggcacctctgtcacgcctactcctttttcttccgcgacagccacccgcgctgctggtttgagttcctctgagggtggtgctcagcctaggcctccgtccctcccctctggctggcaggtgtgacaatgcacacataggccatgaaactcgccgaggaaagacaagcatgtgcactgtggtcttctagttctttcctttgcctttagaaccttagaaataaaaacttttgtggcggtagaggcactgctaactgattcaaaaattaattaggttttgcctgtgggtgtgaggaatgcagaaaattaatgctttagcttttctgcagttttggtgtcggggagaggttccaagcaaactctattaaatggggatttttttttccccataaccacctgaatgtgatttgtgggcttatgtgttctgatttgaacttcatatagcaaggttgtggcttttggcagatgcagtatgttctgagcgcggctcctagagtctacaatttggagtccaggaaggggtggctgtggagacaagtgagttttgtacctccgtaagccaccctttttcagggtcagttcatgtgttagtatcaggggcatctcagatgattaaactcatgggaaaaacttcctccttccctctctccctcttgccctcctgcctctttttttttttttttttttttaatttaggcacttataaaatgttttccctctacctgctgctactctgccaagagccaccaagtgcttatatttttcattttttactcctttagtttggaaagccatatacgtttgagaaggtgttttaaaactctgtgttacacttacgatgcaaagccaaatcagaacttctgtaaggcagaactttcccaactttaaaaaaattattgtcccctctaaggagccttcttagacgttttttcctaatcaccccccaaagacattttaataccacatatatattgtttatgtactatatgtatatacataaacaatacataagcaatacatctgtggtattaaaattaaaaagaatccaattatgtttacctcaaaagaacctgtttttgcttcttgggagcaatattgcccctgtgagactgcatgctataaggtaaggttgtgcttgttaaagacccaagacatgactgggttccacagtctccaaaggaagagggtgggctagtttgtttttattattattttaaaattgtataattggggtctttcttagagttcagaaaaggtatagcttactcttttttaattgtttatttagttgtaagcttggtgattgttttctgatccacattgtgtgtgttcttcaataaaatctttcatttctgcaatttta

SEQ ID NO: 31841 - DNA, 818 bp, Homo sapiens
gcagttccggtgagtccgtgggtggggtccccacctggttggaaggctgtgggtccgggaacccgagcccaaggagtgggggcggccccggagcgaggctcacactccctgccctgcagatgactgtccacaacctgtacctgtttgaccggaatggagtgtgtctgcactacagcgaatggcaccgcaagaagcaagcagggattcccaaggaggaggagtataagctgatgtacgggatgctcttctctatccgctcgtttgtcagcaagatgtccccgctagacatgaaggatggcttcctggccttccaaactagccgttacaaactccattactacgagacgcccactgggatcaaagttgtcatgaatactgacttgggcgtgggacccatccgagatgtgctgcaccacatctacagtgcgctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactaagggcccccactgtaagcccccgcacccccaccccctgcccagagcaacagcctaaaggcctgccctgatgctctcctcctaccagagtgaagcccacagagtccctccacctccacaccaggccctctctccagttttatcccctgcctaatgctgcgagaagcacagaataaactttttgtcactctctgcg

SEQ ID NO: 31842 - DNA, 759 bp, Homo sapiens
aaggggcggagctccgtggaaaccggaagtaactcttgacgggcactcggagcagttccgatgactgtccacaacctgtacctgtttgaccggaatggagtgtgtctgcactacagcgaatggcaccgcaagaagcaagcagggattcccaaggaggaggagtataagctgatgtacgggatgctcttctctatccgctcgtttgtcagcaagatgtccccgctagacatgaaggatggcttcctggccttccaaactagccgttacaaactccattactacgagacgcccactgggatcaaagttgtcatgaatactgacttgggcgtgggacccatccgagatgtgctgcaccacatctacagtgcgctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactaagggcccccactgtaagcccccgcacccccaccccctgcccagagcaacagcctaaaggcctgccctgatgctctcctcctaccagagtgaagcccacagagtccctccacctccacaccaggccctctctccagttttatcccctgcctaatgctgcgagaagcacagaataaactttttgtcactctctgcg

SEQ ID NO: 31843 - DNA, 4552 bp, Homo sapiens
aaagtgcttcctgtgccgggggaggtgggtacagggaagtctcgcctgttggaactggctgtggggctgcggcggtggggacgggccacggcgttctgtgacatccccccgcctcccctcgtcttctcccggctggcggcgaccggcctcagctgcagcgggcccggggcgtggggcctgggttttttgtgacatcgtaaacatgagccccacacagtgggacttccctgtggaattatgttgccggcctatggcctttgttactctaacgggcctggatgtagtttataatgcagtccatcgagctgtctgggacgccttctgtgcaaatcggagagctgatcgagtaccaatttctttcaaggtgctcccaggtgaccatgagtatcccaaatgtagacccaagagaacttcatatgagtggtacattcctaaagggatcttaaagactggctggatgaataagcatctgaatctggtgccagccctggtggttgtgttctatgaactggactgggatgagcctcagtggaaagaaaagcagtctgagtgcgccaccagagtggaaatagtcaggcaaagtttacaaggaagaaacacaaaagttgcagtggttctgattcagaagaaaacccctttgcccccaggagaagatgtcattgcttcagaaagggctgcagctttatgcaatgcatgtgaactctcaggaaagtctttgtttgtactgccgcacactgaccaccttgtgggttatattataagattggaaaatgccttttatgaacatgcacagacttattactacactgagatcagaagagtgaaatctcataaagaatttttgaataaaacaacacaccagcttttatttgttaggcatcagttcaaaatagctttcttcagtgagttgaaacaagatacacaaaatgcgctgaagaattataggaccgcctataatcttgtacacgaattgagagcccatgaaactaatattctggaaattaagactatggcaggatttataaactacaagatctgtaggctgtgttttcaacacaacaccccattggatgcaattgctcagttccgaaaacacatcgacttgtgtaagaaaaagattggaagtgcagagctgtcttttgagcatgatgcatggatgtctaaacaattccaggcctttggagatttatttgatgaagctattaagttagggttaacagctattcaaactcagaatcctggtttctattaccagcaggcagcatactatgcccaggagcggaaacagcttgcaaaaaccctctgtaaccacgaagcttctgtaatgtatcccaatcctgatcccttagaaacacaaacaggcgttcttgacttttatggacaaagatcatggcgacaaggaatactaagttttgatctttctgatcctgaaaaagaaaaggtgggaattcttgccattcagctgaaggagagaaatgttgttcactctgagataatcataactcttctgagcaatgctgttgcacagttcaagaagtataagtgcccgcgaatgaaaagtcacctaatggttcagatgggagaggaatattattacgcaaaggattataccaaagctttgaagttgctggattatgtgatgtgtgattatcggagtgaaggatggtggactctgctcacttctgtattaactacagctctgaagtgctcctacctcatggcccaattaaaggattacattacttactccctagaactccttggtagagcttcaactctgaaagatgaccagaagtctcggatagaaaagaacctcataaatgttttaatgaatgaaagtcctgatccagaacccgactgtgatatcttagctgtgaaaactgctcagaagctgtgggcagaccgaatttctctggctggcagcaatattttcacaataggagtacaggactttgtgccatttgtgcagtgcaaagccaagtttcatgccccaagttttcatgttgatgttcctgttcagtttgatatttatctgaaggctgattgtccacatcccattaggttttccaagctctgtgtcagctttaataatcaggaatacaaccagttctgtgtaatagaagaagcatccaaagcaaatgaagttttagaaaatctgactcaaggaaagatgtgcctagttcctggcaaaacaagaaaactgttatttaagtttgttgcaaaaactgaagatgtgggaaagaaaattgagattacttcagtggatcttgctctgggcaatgagacgggaagatgtgtggttttaaattggcagggaggaggaggagatgctgcttcctcccaagaagccttacaggcagctcggtctttcaaaaggcgacctaagctacctgacaatgaagttcactgggacagcattataattcaggcaagcacaatgatcatatccagagtcccaaacatttctgtacatctgctacatgaaccccctgcactgactaatgaaatgtattgtttggttgtgactgttcagtcccatgaaaagacccaaatcagagatgtgaagctcaccgctggcttaaaaccaggacaggatgccaatttaactcagaagactcacgtgactcttcatggaacagaactgtgtgatgaatcctacccggctttactcactgacattcctgttggagacttacatccaggggaacagctggaaaaaatgttgtatgttcgctgtggaacagtgggttccagaatgtttcttgtatatgtttcttacctgataaatacaaccgttgaagaaaaagaaattgtttgcaagtgtcacaaggatgaaactgtaacaattgaaacagtctttccatttgatgttgcggttaaatttgtttctaccaagtttgagcacctggaaagggtttatgctgacatcccctttctgttgatgacggacctcttaagtgcctcaccctgggccctcactattgtttccagtgagctccagcttgctccatccatgaccacagtggaccagctcgagtctcaagtggacaatgttatcttacagactggagagagtgctagtgaatgcttttgtcttcaatgcccatctcttggaaatattgaaggtggagtagcaaccgggcattatattatctcttggaaaaggacctcagcaatggagaatatccccatcatcacaactgtcatcactctgccgcacgtgattgtggagaatatccctctccatgtgaatgcagatctgccgtcatttgggcgtgtcagagagtcgttacctgtcaagtatcacctacagaataagaccgacttagttcaagatgtagaaatttctgtggagcccagtgatgccttcatgttctcaggtctcaaacagattcgattacgtatcctccctggcacggagcaggaaatgctatataatttctatcctctgatggctggataccagcagctgccatctctcaacatcaacttgcttagatttcctaacttcacaaatcagctgctcaggcgttttatacctaccagtatttttgtcaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctcagtacgacatgaaagaatgtcagaccattgttattgttgaaagtcatttgatgaatggtaaattctatgaaaagtaagtgatttgcatgtataatatcaggaaaattaagcatcccaagtgtgactggacaaagagagcagatgcaccagtgcctgtgccataaagttccgaatcccccatgtgtctctttcagagctggccagaccggaaataaatcattctcataaattcagtgtgtactcagaacacatacacaacaacatagggagttgtatgactgatacggaaaacttccagaaagttttaatcaaagcagtttaattaaggtatcaaaaatatctttgcttactatcaagaagtgtcaaataggttcagcttgctgccaaaatatggatcatttatgaagcaggttcatattttagaggtgttaataaaatcctcatcggaaaagatccaaagtgcaaggatttgattataaacataatttcctagactgaaagtttttggaaaagatgcagggtctgagtcaggccttctggttatattgtgcagtttcaaaagaactatttaaaactcttgaaaactcatgtaaataaaaatcatagggtgaaaattgtatttgttaaaataccttaataatttaaaatgacctgatttcctggaaaattttattattcaaaaggtggaggcattgtaaaaaggaaatagtgatgtaaataaacatgttctctttcaagta

SEQ ID NO: 31844 - DNA, 4406 bp, Homo sapiens
gggtacagggaagtctcgcctgttggaactggctgtggggctgcggcggtggggacgggccacggcgttctgtgacatccccccgcctcccctcgtcttctcccggctggcggcgaccggcctcagctgcagcgggcccggggcgtggggcctgggttttttgtgacatcgtaaacatgagccccacacagtgggacttccctgtggaattatgttgccggcctatggcctttgttactctaacgggcctggatgtagtttataatgcagtccatcgagctgtctgggacgccttctgtgcaaatcggagagctgatcgagtaccaatttctttcaaggtgctcccaggtgaccatgagtatcccaaatgtagacccaagagaacttcatatgagtggtacattcctaaagggatcttaaagactggctggatgaataagcatctgaatctggtgccagccctggtggttgtgttctatgaactggactgggatgagcctcagtggaaagaaaagcagtctgagtgcgccaccagagtggaaatagtcaggcaaagtttacaaggaagaaacacaaaagttgcagtggttctgattcagaagaaaacccctttgcccccaggagaagatgtcattgcttcagaaagggctgcagctttatgcaatgcatgtgaactctcaggaaagtctttgtttgtactgccgcacactgaccaccttgtgggttatattataagattggaaaatgccttttatgaacatgcacagacttattactacactgagatcagaagagtgaaatctcataaagaatttttgaataaaacaacacaccagcttttatttgttaggcatcagttcaaaatagctttcttcagtgagttgaaacaagatacacaaaatgcgctgaagaattataggaccgcctataatcttgtacacgaattgagagcccatgaaactaatattctggaaattaagactatggcaggatttataaactacaagatctgtaggctgtgttttcaacacaacaccccattggatgcaattgctcagttccgaaaacacatcgacttgtgtaagaaaaagattggaagtgcagagctgtcttttgagcatgatgcatggatgtctaaacaattccaggcctttggagatttatttgatgaagctattaagttagggttaacagctattcaaactcagaatcctggtttctattaccagcaggcagcatactatgcccaggagcggaaacagcttgcaaaaaccctctgtaaccacgaagcttctgtaatgtatcccaatcctgatcccttagaaacacaaacaggcgttcttgacttttatggacaaagatcatggcgacaaggaatactaagttttgatctttctgatcctgaaaaagaaaaggtgggaattcttgccattcagctgaaggagagaaatgttgttcactctgagataatcataactcttctgagcaatgctgttgcacagttcaagaagtataagtgcccgcgaatgaaaagtcacctaatggttcagatgggagaggaatattattacgcaaaggattataccaaagctttgaagttgctggattatgtgatgtgtgattatcggagtgaaggatggtggactctgctcacttctgtattaactacagctctgaagtgctcctacctcatggcccaattaaaggattacattacttactccctagaactccttggtagagcttcaactctgaaagatgaccagaagtctcggatagaaaagaacctcataaatgttttaatgaatgaaagtcctgatccagaacccgactgtgatatcttagctgtgaaaactgctcagaagctgtgggcagaccgaatttctctggctggcagcaatattttcacaataggagtacaggactttgtgccatttgtgcagtgcaaagccaagtttcatgccccaagttttcatgttgatgttcctgttcagtttgatatttatctgaaggctgattgtccacatcccattaggttttccaagctctgtgtcagctttaataatcaggaatacaaccagttctgtgtaatagaagaagcatccaaagcaaatgaagttttagaaaatctgactcaaggaaagatgtgcctagttcctggcaaaacaagaaaactgttatttaagtttgttgcaaaaactgaagatgtgggaaagaaaattgagattacttcagtggatcttgctctgggcaatgagacgggaagatgtgtggttttaaattggcagggaggaggaggagatgctgcttcctcccaagaagccttacaggcagctcggtctttcaaaaggcgacctaagctacctgacaatgaagttcactgggacagcattataattcaggcaagcacaatgatcatatccagagtcccaaacatttctgtacatctgctacatgaaccccctgcactgactaatgaaatgtattgtttggttgtgactgttcagtcccatgaaaagacccaaatcagagatgtgaagctcaccgctggcttaaaaccaggacaggatgccaatttaactcagaagactcacgtgactcttcatggaacagaactgtgtgatgaatcctacccggctttactcactgacattcctgttggagacttacatccaggggaacagctggaaaaaatgttgtatgttcgctgtggaacagtgggttccagaatgtttcttgtatatgtttcttacctgataaatacaaccgttgaagaaaaagaaattgtttgcaagtgtcacaaggatgaaactgtaacaattgaaacagtctttccatttgatgttgcggttaaatttgtttctaccaagtttgagcacctggaaagggtttatgctgacatcccctttctgttgatgacggacctcttaagtgcctcaccctgggccctcactattgtttccagtgagctccagcttgctccatccatgaccacagtggaccagctcgagtctcaagtggacaatgttatcttacagactggagagagtgctagtgaatgcttttgtcttcaatgcccatctcttggaaatattgaaggtggagtagcaaccgggcattatattatctcttggaaaaggacctcagcaatggagaatatccccatcatcacaactgtcatcactctgccgcacgtgattgtggagaatatccctctccatgtgaatgcagatctgccgtcatttgggcgtgtcagagagtcgttacctgtcaagtatcacctacagaataagaccgacttagttcaagatgtagaaatttctgtggagcccagtgatgccttcatgttctcaggtctcaaacagattcgattacctgctcaggcgttttatacctaccagtatttttgtcaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctcagtacgacatgaaagaatgtcagaccattgttattgttgaaagtcatttgatgaatggtaaattctatgaaaagtaagtgatttgcatgtataatatcaggaaaattaagcatcccaagtgtgactggacaaagagagcagatgcaccagtgcctgtgccataaagttccgaatcccccatgtgtctctttcagagctggccagaccggaaataaatcattctcataaattcagtgtgtactcagaacacatacacaacaacatagggagttgtatgactgatacggaaaacttccagaaagttttaatcaaagcagtttaattaaggtatcaaaaatatctttgcttactatcaagaagtgtcaaataggttcagcttgctgccaaaatatggatcatttatgaagcaggttcatattttagaggtgttaataaaatcctcatcggaaaagatccaaagtgcaaggatttgattataaacataatttcctagactgaaagtttttggaaaagatgcagggtctgagtcaggccttctggttatattgtgcagtttcaaaagaactatttaaaactcttgaaaactcatgtaaataaaaatcatagggtgaaaattgtatttgttaaaataccttaataatttaaaatgacctgatttcctggaaaattttattattcaaaaggtggaggcattgtaaaaaggaaatagtgatgtaaataaacatgttctctttcaagt

SEQ ID NO: 31845 - DNA, 4466 bp, Homo sapiens
gggtacagggaagtctcgcctgttggaactggctgtggggctgcggcggtggggacgggccacggcgttctgtgacatccccccgcctcccctcgtcttctcccggctggcggcgaccggcctcagctgcagcgggcccggggcgtggggcctgggttttttgtgacatcgtaaacatgagccccacacagtgggacttccctgtggaattatgttgccggcctatggcctttgttactctaacgggcctggatgtagtttataatgcagtccatcgagctgtctgggacgccttctgtgcaaatcggagagctgatcgagtaccaatttctttcaaggtgctcccaggtgaccatgagtatcccaaatgtagacccaagagaacttcatatgagtggtacattcctaaagggatcttaaagactggctggatgaataagcatctgaatctggtgccagccctggtggttgtgttctatgaactggactgggatgagcctcagtggaaagaaaagcagtctgagtgcgccaccagagtggaaatagtcaggcaaagtttacaaggaagaaacacaaaagttgcagtggttctgattcagaagaaaacccctttgcccccaggagaagatgtcattgcttcagaaagggctgcagctttatgcaatgcatgtgaactctcaggaaagtctttgtttgtactgccgcacactgaccaccttgtgggttatattataagattggaaaatgccttttatgaacatgcacagacttattactacactgagatcagaagagtgaaatctcataaagaatttttgaataaaacaacacaccagcttttatttgttaggcatcagttcaaaatagctttcttcagtgagttgaaacaagatacacaaaatgcgctgaagaattataggaccgcctataatcttgtacacgaattgagagcccatgaaactaatattctggaaattaagactatggcaggatttataaactacaagatctgtaggctgtgttttcaacacaacaccccattggatgcaattgctcagttccgaaaacacatcgacttgtgtaagaaaaagattggaagtgcagagctgtcttttgagcatgatgcatggatgtctaaacaattccaggcctttggagatttatttgatgaagctattaagttagggttaacagctattcaaactcagaatcctggtttctattaccagcaggcagcatactatgcccaggagcggaaacagcttgcaaaaaccctctgtaaccacgaagcttctgtaatgtatcccaatcctgatcccttagaaacacaaacaggcgttcttgacttttatggacaaagatcatggcgacaaggaatactaagttttgatctttctgatcctgaaaaagaaaaggtgggaattcttgccattcagctgaaggagagaaatgttgttcactctgagataatcataactcttctgagcaatgctgttgcacagttcaagaagtataagtgcccgcgaatgaaaagtcacctaatggttcagatgggagaggaatattattacgcaaaggattataccaaagctttgaagttgctggattatgtgatgtgtgattatcggagtgaaggatggtggactctgctcacttctgtattaactacagctctgaagtgctcctacctcatggcccaattaaaggattacattacttactccctagaactccttggtagagcttcaactctgaaagatgaccagaagtctcggatagaaaagaacctcataaatgttttaatgaatgaaagtcctgatccagaacccgactgtgatatcttagctgtgaaaactgctcagaagctgtgggcagaccgaatttctctggctggcagcaatattttcacaataggagtacaggactttgtgccatttgtgcagtgcaaagccaagtttcatgccccaagttttcatgttgatgttcctgttcagtttgatatttatctgaaggctgattgtccacatcccattaggttttccaagctctgtgtcagctttaataatcaggaatacaaccagttctgtgtaatagaagaagcatccaaagcaaatgaagttttagaaaatctgactcaaggaaagatgtgcctagttcctggcaaaacaagaaaactgttatttaagtttgttgcaaaaactgaagatgtgggaaagaaaattgagattacttcagtggatcttgctctgggcaatgagacgggaagatgtgtggttttaaattggcagggaggaggaggagatgctgcttcctcccaagaagccttacaggcagctcggtctttcaaaaggcgacctaagctacctgacaatgaagttcactgggacagcattataattcaggcaagcacaatgatcatatccagagtcccaaacatttctgtacatctgctacatgaaccccctgcactgactaatgaaatgtattgtttggttgtgactgttcagtcccatgaaaagacccaaatcagagatgtgaagctcaccgctggcttaaaaccaggacaggatgccaatttaactcagaagactcacgtgactcttcatggaacagaactgtgtgatgaatcctacccggctttactcactgacattcctgttggagacttacatccaggggaacagctggaaaaaatgttgtatgttcgctgtggaacagtgggttccagaatgtttcttgtatatgtttcttacctgataaatacaaccgttgaagaaaaagaaattgtttgcaagtgtcacaaggatgaaactgtaacaattgaaacagtctttccatttgatgttgcggttaaatttgtttctaccaagtttgagcacctggaaagggtttatgctgacatcccctttctgttgatgacggacctcttaagtgcctcaccctgggccctcactattgtttccagtgagctccagcttgctccatccatgaccacagtggaccagctcgagtctcaagtggacaatgttatcttacagactggagagagtgctagtgcattatattatctcttggaaaaggacctcagcaatggagaatatccccatcatcacaactgtcatcactctgccgcacgtgattgtggagaatatccctctccatgtgaatgcagatctgccgtcatttgggcgtgtcagagagtcgttacctgtcaagtatcacctacagaataagaccgacttagttcaagatgtagaaatttctgtggagcccagtgatgccttcatgttctcaggtctcaaacagattcgattacgtatcctccctggcacggagcaggaaatgctatataatttctatcctctgatggctggataccagcagctgccatctctcaacatcaacttgcttagatttcctaacttcacaaatcagctgctcaggcgttttatacctaccagtatttttgtcaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctcagtacgacatgaaagaatgtcagaccattgttattgttgaaagtcatttgatgaatggtaaattctatgaaaagtaagtgatttgcatgtataatatcaggaaaattaagcatcccaagtgtgactggacaaagagagcagatgcaccagtgcctgtgccataaagttccgaatcccccatgtgtctctttcagagctggccagaccggaaataaatcattctcataaattcagtgtgtactcagaacacatacacaacaacatagggagttgtatgactgatacggaaaacttccagaaagttttaatcaaagcagtttaattaaggtatcaaaaatatctttgcttactatcaagaagtgtcaaataggttcagcttgctgccaaaatatggatcatttatgaagcaggttcatattttagaggtgttaataaaatcctcatcggaaaagatccaaagtgcaaggatttgattataaacataatttcctagactgaaagtttttggaaaagatgcagggtctgagtcaggccttctggttatattgtgcagtttcaaaagaactatttaaaactcttgaaaactcatgtaaataaaaatcatagggtgaaaattgtatttgttaaaataccttaataatttaaaatgacctgatttcctggaaaattttattattcaaaaggtggaggcattgtaaaaaggaaatagtgatgtaaataaacatgttctctttcaagt

SEQ ID NO: 31846 - DNA, 2505 bp, Homo sapiens
tttccggcctgggggcagggcctcgggttcctgcatcgggcctgagcagaactaggcgcgccgcggcccggcacgcgcaggcgtacagagctccccgggggtgccagttcctctccgattcccggcttctgtcaccttcctcacggaccttggtcacggccgcaggtgaccccttagcccagctccagtgggcgggtggcagggtcatggaggacgctggcggcggcgaggagcaggggttgctcttccaggaggaaaccatcgatcttggcggagatgagtttggatccgaagagaacgagaccgcatcggaaggctcgagtcctctcgcggacaagctgaacgaacacatgatggagagcgtcctcatctctgactcccccaacagcgagggcgacgcgggcgacctgggccgagtgcgggacgaagctgagcccggaggggaaggcgacccaggcccggagcccgcgggcaccccgagtcccagcggcgaggccgacggcgactgtgcccccgaggacgcggcacccagtagcggaggggccccgaggcaggacgcggcccgcgaggtcccaggcagcgaagccgcgcgcccggagcaggagcctcccgttgcggagccggtcccggtgtgcaccatcttcagccagcgcgcgcccccagcctccggggacggcttcgagccgcagatggtgaagtcgcccagcttcggtggcgccagcgaggcctcggccaggacaccgccccaggtcgtgcagcccagccccagcctcagcacgttcttcggagacacggccgccagccactccttggcctcggacttcttcgactcctttactacctccgccttcatttccgtcagcaatcccggcgcgggctccccggcccccgccagcccgcctcccctcgctgtgcccgggaccgaggggcgccccgaacccgtggccatgcgagggccccaggcagctgcgcccccggcgtcgccagagcctttcgcgcacatccaggcagtgtttgcagggagtgacgacccctttgccaccgccctgagcatgagcgagatggaccggaggaacgacgcctggcttcccggcgaggctacgcgtggagtcctgcgggccgtggccacccagcagcgcggcgccgtgttcgtggacaaggagaacctcaccatgccgggcctcaggttcgacaacatccagggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaaggctgctcttaccttgtagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctgcagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtgcagatgctgtcagcctcgcatcctacaggaaaggaaccatcgccaaaagacgctgaggaacatcccgagggtcacagggacagtgcagagccaggaccagcccggcccatggtcccccagcgtgcaccacctggcccggcactgtgtgctcagccatgaggactgggaagagtcctgcccacagctcaagtgtctacaccgcactgccatccaggctgtgagccgctgctgagcatggggaatgtggctgctgcagagacgttatgaaacacttctaaaagaatgtaaaagatctcattaataattttgagtacctgttaaaatgatagtaattttggatctagtagattaaataaaacatattatt

SEQ ID NO: 31847 - DNA, 2508 bp, Homo sapiens
ggggcagggcctcgggttcctgcatcgggcctgagcagaactaggcgcgccgcggcccggcacgcgcaggcgtacagagctccccgggggtgccagttcctctccgattcccggcttctgtcaccttcctcacggaccttggtcacggccgcaggtgaccccttagcccagctccagtgggcgggtggcagggtcatggaggacgctggcggcggcgaggagaccccggccccggaggccccgcacccccctcagctcgcgcctccggaggagcaggggttgctcttccaggaggaaaccatcgatcttggcggagatgagtttggatccgaagagaacgagaccgcatcggaaggctcgagtcctctcgcggacaagctgaacgaacacatgatggagagcgtcctcatctctgactcccccaacagcgagggcgacgcgggcgacctgggccgagtgcgggacgaagctgagcccggaggggaaggcgacccaggcccggagcccgcgggcaccccgagtcccagcggcgaggccgacggcgactgtgcccccgaggacgcggcacccagtagcggaggggccccgaggcaggacgcggcccgcgaggtcccaggcagcgaagccgcgcgcccggagcaggagcctcccgttgcggagccggtcccggtgtgcaccatcttcagccagcgcgcgcccccagcctccggggacggcttcgagccgcagatggtgaagtcgcccagcttcggtggcgccagcgaggcctcggccaggacaccgccccaggtcgtgcagcccagccccagcctcagcacgttcttcggagacacggccgccagccactccttggcctcggacttcttcgactcctttactacctccgccttcatttccgtcagcaatcccggcgcgggctccccggcccccgccagcccgcctcccctcgctgtgcccgggaccgaggggcgccccgaacccgtggccatgcgagggccccaggcagctgcgcccccggcgtcgccagagcctttcgcgcacatccaggcagtgtttgcagggagtgacgacccctttgccaccgccctgagcatgagcgagatggaccggaggaacgacgcctggcttcccggcgaggctacgcgtggagtcctgcgggccgtggccacccagcagcgcggcgccgtgttcgtggacaaggagaacctcaccatgccgggcctcaggttcgacaacatccagggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctgcagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcac

SEQ ID NO: 31848 - DNA, 2483 bp, Homo sapiens
tttccggcctgggggcagggcctcgggttcctgcatcgggcctgagcagaactaggcgcgccgcggcccggcacgcgcaggcgtacagagctccccgggggtgccagttcctctccgattcccggcttctgtcaccttcctcacggaccttggtcacggccgcagggtcatggaggacgctggcggcggcgaggagaccccggccccggaggccccgcacccccctcagctcgcgcctccggaggagcaggggttgctcttccaggaggaaaccatcgatcttggcggagatgagtttggatccgaagagaacgagaccgcatcggaaggctcgagtcctctcgcggacaagctgaacgaacacatgatggagagcgtcctcatctctgactcccccaacagcgagggcgacgcgggcgacctgggccgagtgcgggacgaagctgagcccggaggggaaggcgacccaggcccggagcccgcgggcaccccgagtcccagcggcgaggccgacggcgactgtgcccccgaggacgcggcacccagtagcggaggggccccgaggcaggacgcggcccgcgaggtcccaggcagcgaagccgcgcgcccggagcaggagcctcccgttgcggagccggtcccggtgtgcaccatcttcagccagcgcgcgcccccagcctccggggacggcttcgagccgcagatggtgaagtcgcccagcttcggtggcgccagcgaggcctcggccaggacaccgccccaggtcgtgcagcccagccccagcctcagcacgttcttcggagacacggccgccagccactccttggcctcggacttcttcgactcctttactacctccgccttcatttccgtcagcaatcccggcgcgggctccccggcccccgccagcccgcctcccctcgctgtgcccgggaccgaggggcgccccgaacccgtggccatgcgagggccccaggcagctgcgcccccggcgtcgccagagcctttcgcgcacatccaggcagtgtttgcagggagtgacgacccctttgccaccgccctgagcatgagcgagatggaccggaggaacgacgcctggcttcccggcgaggctacgcgtggagtcctgcgggccgtggccacccagcagcgcggcgccgtgttcgtggacaaggagaacctcaccatgccgggcctcaggttcgacaacatccagggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctgcagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcact

SEQ ID NO: 31849 - DNA, 1980 bp, Homo sapiens
ggctacaggttcggggcgcgggtctcttccgcggaaactgacattgcgtttccgttgtcggcctcccactgcaggagccatatattgaagaccatgtctgggagcttctactttgtaattgttggccaccatgataatccagtttttgaaatggagtttttgccagctgggaaggcagaatccaaagacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatgaggtttattatgcttcatgacataagacaagaagatggaataaagaacttctttactgatgtttatgatttatatataaagttttcaatgaatccattttatgaacccaattctcctattcgatcaagtgcatttgacagaaaagttcagtttcttgggaagaaacaccttttaagctgaatgcagaaaattccaaaataaatgatgtcaccacaatggtgtatactcaggaatgtgtacattgtaagttacttgattaaatagcctggaaaacttttgtgtattctcagcttatctaaacctaatgaaattccttttatatttaaaaatagtacattctgtctcatgtcacgtatcaatagatcaattggtatttccttgtgaacagtgttatttataaagagttcattatcaataatcatgttttttttttttttttttttctgatacagagtctcactctgttgccaggctggagtgcagtggcgcaatcttggctcactgcaacctccgcctcccaggttcaggcgattctcctgcctcagcctccaagtagctgggactacaggcgcgtgccaccacgcccggctaatttttgtatttttagtagagacagggtttcaccatattggtcaggctggtcttgaactcctgacctcgtgatctgcccgcctcagcctcccaaagtgctaggattacaggcatgaaccaccgtgcccggccaggaataagcttttgacttacccaattcagataggttgatctttggggttttttttttttttttgagatggagtttcgctctgttgtccaggctggagtgcaatggcagttgtttcaccgtaacctctgcctcctgacttcaagcaattctcctgcctcagcctcccaaagtgctgggattacaggtgtgagccaccgtgcccggcccagataggttgatcttaatgtaacaacccaaaaataaatgtcatagtcaagatttggtagataaatttaaaattaaaatattctgcagttgggagtgaaatgtgatagcacatacgttgacattatgcatttagagatgttataaaaatgtataggcagtatacacagcactactcaagaagccaaagaaacacttgtgcagtgctaagtgtcacatgtctgcttccaccagaggctaggaatagtgatcctgctataatgtgagaacccaaatcatgtttataaaataggacgctgggagcagttgcaggccacagtgaagtgtgttgcttctgtcactttatattcttatatttcctttccctcagacagtaaactgttgatactcgtacttgtaaaaaattgtaaggcaatttttagtattgttgtcaaagaaaagcttggattacattaacatttgtattcagtcttttaggtgatacaccagagggggctgggaattgtctctttgttcctataagtagatcttaatgtaaaatagtaaatgtccattgaaaagcaagtaatacagcctgtgctaattgggagcacttgaacaattttgttccattctgagtaacttttgagcaagtaattctaagctttgtcttgtatccttgtgtgaaattgcataatttttaccctatttgatttcttaaataaagatgtttgctc

SEQ ID NO: 31850 - DNA, 2716 bp, Homo sapiens
acatcccagggtatcgcgagaactgcttcggcgttctggctacaggttcggggcgcgggtctcttccgcggaaactgacattgcgtttccgttgtcggcctcccactgcaggagccatatattgaagaccatgtctgggagcttctactttgtaattgttggccaccatgataatccagtttttgaaatggagtttttgccagctgggaaggcagaatccaaagacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatgaggtttattatgcttcatgacataagacaagaagatggaataaagaacttctttactgatgtttatgatttatatataaagttttcaatgaatccattttatgaacccaattctcctattcgatcaagtgcatttgacagaaaagttcagtttcttgggaagaaacaccttttaagctgaatgcagaaaattccaaaataaatgatgtcaccacaatggtgtatactcaggaatgtgtacattgtaagttacttgattaaatagcctggaaaacttttgtgtattctcagcttatctaaacctaatgaaattccttttatatttaaaaatagtacattctgtctcatgtcacgtatcaatagatcaattggtatttccttgtgaacagtgttatttataaagagttcattatcaataatcatgttttttttttttttttttttctgatacagagtctcactctgttgccaggctggagtgcagtggcgcaatcttggctcactgcaacctccgcctcccaggttcaggcgattctcctgcctcagcctccaagtagctgggactacaggcgcgtgccaccacgcccggctaatttttgtatttttagtagagacagggtttcaccatattggtcaggctggtcttgaactcctgacctcgtgatctgcccgccttggcctcccaaagtactgggattacaggcgtgagccaccgtgcccaaccatgaaatatttttacttaaaaattgggaataagctcgctttttttttttttgagatggagtcttgctcctgttgtgcaggctgtagtgcagtggcacgatcttggctcactgcaacctccacctcccgggttcaagcaattctccttcttcagcctcccgagtagctgagattataggcgtgcaccaccacacctggctaatttttgtatttttagtagagacagggtttcaccatattggtcaggctggtcttgaactcctgacctcgtgatccacccacctcaggaagtgctgggattacaggcgtgtgagccaccacgcccggccatgaaatatttttacttaaaaattgggaataagctttttggttttttgtgggtttttgtttttgttttttgttttttgtttttttgagatggagtcttgctcctgttgtgcaggctggagtgcagtggcacagtcttggctcactgcaacctccacctcctgggttcaagcaattctccttcttcagcctcccgagtagctgggattacaggcatgcaccaccacacctggctaatttttgtgtttttagtagagacggggtttcgctattttggccgggctggtttcaaactcctgacctcagttgatccacccgcctcagcctcccaaagtgctaggattacaggcatgaaccaccgtgcccggccaggaataagcttttgacttacccaattcagataggttgatctttggggttttttttttttttttgagatggagtttcgctctgttgtccaggctggagtgcaatggcagttgtttcaccgtaacctctgcctcctgacttcaagcaattctcctgcctcagcctcccaaagtgctgggattacaggtgtgagccaccgtgcccggcccagataggttgatcttaatgtaacaacccaaaaataaatgtcatagtcaagatttggtagataaatttaaaattaaaatattctgcagttgggagtgaaatgtgatagcacatacgttgacattatgcatttagagatgttataaaaatgtataggcagtatacacagcactactcaagaagccaaagaaacacttgtgcagtgctaagtgtcacatgtctgcttccaccagaggctaggaatagtgatcctgctataatgtgagaacccaaatcatgtttataaaataggacgctgggagcagttgcaggccacagtgaagtgtgttgcttctgtcactttatattcttatatttcctttccctcagacagtaaactgttgatactcgtacttgtaaaaaattgtaaggcaatttttagtattgttgtcaaagaaaagcttggattacattaacatttgtattcagtcttttaggtgatacaccagagggggctgggaattgtctctttgttcctataagtagatcttaatgtaaaatagtaaatgtccattgaaaagcaagtaatacagcctgtgctaattgggagcacttgaacaattttgttccattctgagtaacttttgagcaagtaattctaagctttgtcttgtatccttgtgtgaaattgcataatttttaccctatttgatttcttaaataaagatgtttgctcaag

SEQ ID NO: 31851 - DNA, 2776 bp, Homo sapiens
attgcgtttccgttgtcggcctcccactgcagtatcaccttctcccccaagtgtgacaaccaaagatgtctccagatattgccagatgtcctcttggaagcaagatcgctccgggttgagatccacagagctaaacgttttagagtaccaaccattgtgtgctgtgaggtaaaggagccatatattgaagaccatgtctgggagcttctactttgtaattgttggccaccatgataatccagtttttgaaatggagtttttgccagctgggaaggcagaatccaaagacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatgaggtttattatgcttcatgacataagacaagaagatggaataaagaacttctttactgatgtttatgatttatatataaagttttcaatgaatccattttatgaacccaattctcctattcgatcaagtgcatttgacagaaaagttcagtttcttgggaagaaacaccttttaagctgaatgcagaaaattccaaaataaatgatgtcaccacaatggtgtatactcaggaatgtgtacattgtaagttacttgattaaatagcctggaaaacttttgtgtattctcagcttatctaaacctaatgaaattccttttatatttaaaaatagtacattctgtctcatgtcacgtatcaatagatcaattggtatttccttgtgaacagtgttatttataaagagttcattatcaataatcatgttttttttttttttttttttctgatacagagtctcactctgttgccaggctggagtgcagtggcgcaatcttggctcactgcaacctccgcctcccaggttcaggcgattctcctgcctcagcctccaagtagctgggactacaggcgcgtgccaccacgcccggctaatttttgtatttttagtagagacagggtttcaccatattggtcaggctggtcttgaactcctgacctcgtgatctgcccgccttggcctcccaaagtactgggattacaggcgtgagccaccgtgcccaaccatgaaatatttttacttaaaaattgggaataagctcgctttttttttttttgagatggagtcttgctcctgttgtgcaggctgtagtgcagtggcacgatcttggctcactgcaacctccacctcccgggttcaagcaattctccttcttcagcctcccgagtagctgagattataggcgtgcaccaccacacctggctaatttttgtatttttagtagagacagggtttcaccatattggtcaggctggtcttgaactcctgacctcgtgatccacccacctcaggaagtgctgggattacaggcgtgtgagccaccacgcccggccatgaaatatttttacttaaaaattgggaataagctttttggttttttgtgggtttttgtttttgttttttgttttttgtttttttgagatggagtcttgctcctgttgtgcaggctggagtgcagtggcacagtcttggctcactgcaacctccacctcctgggttcaagcaattctccttcttcagcctcccgagtagctgggattacaggcatgcaccaccacacctggctaatttttgtgtttttagtagagacggggtttcgctattttggccgggctggtttcaaactcctgacctcagttgatccacccgcctcagcctcccaaagtgctaggattacaggcatgaaccaccgtgcccggccaggaataagcttttgacttacccaattcagataggttgatctttggggttttttttttttttttgagatggagtttcgctctgttgtccaggctggagtgcaatggcagttgtttcaccgtaacctctgcctcctgacttcaagcaattctcctgcctcagcctcccaaagtgctgggattacaggtgtgagccaccgtgcccggcccagataggttgatcttaatgtaacaacccaaaaataaatgtcatagtcaagatttggtagataaatttaaaattaaaatattctgcagttgggagtgaaatgtgatagcacatacgttgacattatgcatttagagatgttataaaaatgtataggcagtatacacagcactactcaagaagccaaagaaacacttgtgcagtgctaagtgtcacatgtctgcttccaccagaggctaggaatagtgatcctgctataatgtgagaacccaaatcatgtttataaaataggacgctgggagcagttgcaggccacagtgaagtgtgttgcttctgtcactttatattcttatatttcctttccctcagacagtaaactgttgatactcgtacttgtaaaaaattgtaaggcaatttttagtattgttgtcaaagaaaagcttggattacattaacatttgtattcagtcttttaggtgatacaccagagggggctgggaattgtctctttgttcctataagtagatcttaatgtaaaatagtaaatgtccattgaaaagcaagtaatacagcctgtgctaattgggagcacttgaacaattttgttccattctgagtaacttttgagcaagtaattctaagctttgtcttgtatccttgtgtgaaattgcataatttttaccctatttgatttcttaaataaagatgtttgctc

SEQ ID NO: 31852 - DNA, 1982 bp, Homo sapiens
ggctacaggttcggggcgcgggtctcttccgcggaaactgacattgcgtttccgttgtcggcctcccactgcaggagccatatattgaagaccatgtctgggagcttctactttgtaattgttggccaccatgataatccagtttttgaaatggagtttttgccagctgggaaggcagaatccaaagacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatgaggtttattatgcttcatgacataagacaagaagatggaataaagaacttctttactgatgtttatgatttatatataaagttttcaatgaatccattttatgaacccaattctcctattcgatcaagtgcatttgacagaaaagttcagtttcttgggaagaaacaccttttaagctgaatgcagaaaattccaaaataaatgatgtcaccacaatggtgtatactcaggaatgtgtacattgtaagttacttgattaaatagcctggaaaacttttgtgtattctcagcttatctaaacctaatgaaattccttttatatttaaaaatagtacattctgtctcatgtcacgtatcaatagatcaattggtatttccttgtgaacagtgttatttataaagagttcattatcaataatcatgttttttttttttttttttttctgatacagagtctcactctgttgccaggctggagtgcagtggcgcaatcttggctcactgcaacctccgcctcccaggttcaggcgattctcctgcctcagcctccaagtagctgggactacaggcgcgtgccaccacgcccggctaatttttgtatttttagtagagacagggtttcaccatattggtcaggctggtcttgaactcctgacctcttgatccacccgcctcagcctcccaaagtgctaggattacaggcatgaaccaccgtgcccggccaggaataagcttttgacttacccaattcagataggttgatctttggggttttttttttttttttgagatggagtttcgctctgttgtccaggctggagtgcaatggcagttgtttcaccgtaacctctgcctcctgacttcaagcaattctcctgcctcagcctcccaaagtgctgggattacaggtgtgagccaccgtgcccggcccagataggttgatcttaatgtaacaacccaaaaataaatgtcatagtcaagatttggtagataaatttaaaattaaaatattctgcagttgggagtgaaatgtgatagcacatacgttgacattatgcatttagagatgttataaaaatgtataggcagtatacacagcactactcaagaagccaaagaaacacttgtgcagtgctaagtgtcacatgtctgcttccaccagaggctaggaatagtgatcctgctataatgtgagaacccaaatcatgtttataaaataggacgctgggagcagttgcaggccacagtgaagtgtgttgcttctgtcactttatattcttatatttcctttccctcagacagtaaactgttgatactcgtacttgtaaaaaattgtaaggcaatttttagtattgttgtcaaagaaaagcttggattacattaacatttgtattcagtcttttaggtgatacaccagagggggctgggaattgtctctttgttcctataagtagatcttaatgtaaaatagtaaatgtccattgaaaagcaagtaatacagcctgtgctaattgggagcacttgaacaattttgttccattctgagtaacttttgagcaagtaattctaagctttgtcttgtatccttgtgtgaaattgcataatttttaccctatttgatttcttaaataaagatgtttgctcaa

SEQ ID NO: 31853 - DNA, 2879 bp, Homo sapiens
acatcccagggtatcgcgagaactgcttcggcgttctggctacaggttcggggcgcgggtctcttccgcggaaactgacattgcgtttccgttgtcggcctcccactgcagtatcaccttctcccccaagtgtgacaaccaaagatgtctccagatattgccagatgtcctcttggaagcaagatcgctccgggttgagatccacagagctaaacgttttagagtaccaaccattgtgtgctgtgaggtaaaggagccatatattgaagaccatgtctgggagcttctactttgtaattgttggccaccatgataatccagtttttgaaatggagtttttgccagctgggaaggcagaatccaaagacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatccttaccttcttagtaaagatgaggtttattatgcttcatgacataagacaagaagatggaataaagaacttctttactgatgtttatgatttatatataaagttttcaatgaatccattttatgaacccaattctcctattcgatcaagtgcatttgacagaaaagttcagtttcttgggaagaaacaccttttaagctgaatgcagaaaattccaaaataaatgatgtcaccacaatggtgtatactcaggaatgtgtacattgtaagttacttgattaaatagcctggaaaacttttgtgtattctcagcttatctaaacctaatgaaattccttttatatttaaaaatagtacattctgtctcatgtcacgtatcaatagatcaattggtatttccttgtgaacagtgttatttataaagagttcattatcaataatcatgttttttttttttttttttttctgatacagagtctcactctgttgccaggctggagtgcagtggcgcaatcttggctcactgcaacctccgcctcccaggttcaggcgattctcctgcctcagcctccaagtagctgggactacaggcgcgtgccaccacgcccggctaatttttgtatttttagtagagacagggtttcaccatattggtcaggctggtcttgaactcctgacctcgtgatctgcccgccttggcctcccaaagtactgggattacaggcgtgagccaccgtgcccaaccatgaaatatttttacttaaaaattgggaataagctcgctttttttttttttgagatggagtcttgctcctgttgtgcaggctgtagtgcagtggcacgatcttggctcactgcaacctccacctcccgggttcaagcaattctccttcttcagcctcccgagtagctgagattataggcgtgcaccaccacacctggctaatttttgtatttttagtagagacagggtttcaccatattggtcaggctggtcttgaactcctgacctcgtgatccacccacctcaggaagtgctgggattacaggcgtgtgagccaccacgcccggccatgaaatatttttacttaaaaattgggaataagctttttggttttttgtgggtttttgtttttgttttttgttttttgtttttttgagatggagtcttgctcctgttgtgcaggctggagtgcagtggcacagtcttggctcactgcaacctccacctcctgggttcaagcaattctccttcttcagcctcccgagtagctgggattacaggcatgcaccaccacacctggctaatttttgtgtttttagtagagacggggtttcgctattttggccgggctggtttcaaactcctgacctcagttgatccacccgcctcagcctcccaaagtgctaggattacaggcatgaaccaccgtgcccggccaggaataagcttttgacttacccaattcagataggttgatctttggggttttttttttttttttgagatggagtttcgctctgttgtccaggctggagtgcaatggcagttgtttcaccgtaacctctgcctcctgacttcaagcaattctcctgcctcagcctcccaaagtgctgggattacaggtgtgagccaccgtgcccggcccagataggttgatcttaatgtaacaacccaaaaataaatgtcatagtcaagatttggtagataaatttaaaattaaaatattctgcagttgggagtgaaatgtgatagcacatacgttgacattatgcatttagagatgttataaaaatgtataggcagtatacacagcactactcaagaagccaaagaaacacttgtgcagtgctaagtgtcacatgtctgcttccaccagaggctaggaatagtgatcctgctataatgtgagaacccaaatcatgtttataaaataggacgctgggagcagttgcaggccacagtgaagtgtgttgcttctgtcactttatattcttatatttcctttccctcagacagtaaactgttgatactcgtacttgtaaaaaattgtaaggcaatttttagtattgttgtcaaagaaaagcttggattacattaacatttgtattcagtcttttaggtgatacaccagagggggctgggaattgtctctttgttcctataagtagatcttaatgtaaaatagtaaatgtccattgaaaagcaagtaatacagcctgtgctaattgggagcacttgaacaattttgttccattctgagtaacttttgagcaagtaattctaagctttgtcttgtatccttgtgtgaaattgcataatttttaccctatttgatttcttaaataaagatgtttgctcaag

SEQ ID NO: 31854 - DNA, 678 bp, Homo sapiens
ctcttccgcggaaactgacattgcgtttccgttgtcggcctcccactgcagtatcaccttctcccccaagtgtgacaaccaaagatgtctccagatattgccagatgtcctcttggaagcaagatcgctccgggttgagatccacagagctaaacgttttagagtaccaaccattgtgtgctgtgaggagccatatattgaagaccatgtctgggagcttctactttgtaattgttggccaccatgataatccagtttttgaaatggagtttttgccagctgggaaggcagaatccaaagacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatgaggtttattatgcttcatgacataagacaagaagatggaataaagaacttctttactgatgtttatgatttatatataaagttttcaatgaatccattttatgaacccaattctcctattcgatcaagtgcatttgacagaaaagttcagtttcttgggaagaaacaccttttaagctgaatgcagaaaattccaaaataaatgatgtcaccacaatggtgtatactca

SEQ ID NO: 31855 - DNA, 562 bp, Homo sapiens
atcccagggtatcgcgagaactgcttcggcgttctggctacaggttcggggcgcgggtctcttccgcggaaactgacattgcgtttccgttgtcggcctcccactgcagtatcaccttctcccccaagtgtgacaaccaaagatgtctccagatattgccagatgtcctcttggaagcaagatcgctccgggttgagatccacagagctaaacgttttagagtaccaaccattgtgtgctgtgaggtaaaggtaagtgacatgaggtagagttggttttagcttcccccgacggatgcctcctggaaatttctaaggcaaggagccatatattgaagaccatgtctgggagcttctactttgtaattgttggccaccatgataatccagtttttgaaatggagtttttgccagctgggaaggcagaatccaaagacgaccatcgtcatctgaaccagttcatagctcatgctgctctcgacctcgtagatgagaacatgtggctatcgaacaacatgtacttgaaaactgtggacaagttcaacgagtggtttgtgtcggca

SEQ ID NO: 31856 - DNA, 2215 bp, Homo sapiens
gctttggaggccgcgtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagcagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacatatttgccttttcatcccatctagcaagcacagtgttaattttagaaattatagaagaaaaaatcagcaaggagtgtgggaaaactgcatgccccaggcctcccccgccccagggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggtttaagccactga

SEQ ID NO: 31857 - DNA, 590 bp, Homo sapiens
gcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggaaagaaaaatgtttctgggaaaacaaaacaaaacaaagcgacaggcaaaactgtatgatgccgtgaaggagaggggtgcagcatcatgtacagatgcttctcctttgttgtcctgagtatctgaagtgtcatcttgcagaggccacaggtggcgttcaagatgtacttgggcatcactccaagcattactaattggagcccagctggtgatgaattctccctcattttgga

SEQ ID NO: 31858 - DNA, 1056 bp, Homo sapiens
cgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatggtaacttggagcgcgtgacctcggcgggcggggcgaaattgaggcgtacagggaaggggcccggcgccgagcgcgaggtgcgtttggaaaagggccttcctgtgagctctggcaaggggaagcctcttgctgggtcactccgggggcgttccaggcaggtgaggggaccgtcggagaagttccccggaggagaccccgcccccaaggcctgagtgcagctctgtgctaagccaacaacaacgacgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagag

SEQ ID NO: 31859 - DNA, 951 bp, Homo sapiens
cttaggctccggcgtctgcaggggtcgccgagctaacccgtggctaggcgagtggggcggggcggccggcaccatgtcgaggcaggcgaaccgtggcaccgagagcaagaaaatggtaacttggagcgcgtgacctcggcgggcggggcgaaattgaggcgtacagggaaggggcccggcgccgagcgcgagagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactaga

SEQ ID NO: 31860 - DNA, 1265 bp, Homo sapiens
tgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaa

SEQ ID NO: 31861 - DNA, 794 bp, Homo sapiens
gaataccagtttccgagcggcaaggcagcgatggcgatttttagtgtgtatgtggtgaacaaagctggcggcttgatttaccagttggacagctacgcgccacgggctgaggctgagaaaactttcagttatccgctggatctgctgctcaagctacacgatgagcgtgtgttggttgctttcggccagcgggacggcatccgagtgggtcatgcagtgctggccatcaatggcatggacgtgaatggcaggtacacggccgacgggaaagagatgctggagacagacacattcaaattgcactgctaccagacactgacagggatcaagtttgtggttctagcagatcctaggcaagctggaatagattctcttctccgaaagatttatgagatttactcagactttgccctcaagaatccattctattccttagaaatgcctatcaggtgtgagctctttgaccagaacctgaagctagctctggaggtggcagagaaggctggaacttttggacctgggtcataggctgaacctgttatggacccccaaattctgagagttcctgcaacaagaatactgctgttgacactccagtggaaatcccagcagccttgttagtgcacttgaaagtgggagaatgctgaccctgatgacttgtactgattcctgagccttaacactgtgctctttccttctgtatataccatggtcttactttccaactctgtacagatttatttatggaggagctaggtccataaatgttgtaataaatattcctttgatcttgg

SEQ ID NO: 31862 - DNA, 1759 bp, Homo sapiens
cggcgaagcgctcgccctctagcctgaggcggaagacaggaagtggattctagttcccaagccgcaccgcctaaatactgccggagtctgcgctagttgtgacgcatactatagcgctgttttcctgcactgataaacgaaaagcaatccaccaggtctcggcagctaactttccggcactacttatgcccgagcgtgtcgctcccagtgcgcaagtgcagcaggtggctgcacggggggcgcgggaggaggaggaggaggaggaggaggctggggtggggccggcggcaagtgctgtgatgcggttccggggaggggccgtcgggtagaggctgaataccagtttccgagcggcaaggcagcgatggcgatttttagtgtgtatgtggtgaacaaagctggcggcttgatttaccagttggacagctacgcgccacgggctgaggctgagaaaactttcagttatccgctggatctgctgctcaagctacacgatgagcgtgtgttggttgctttcggccagcgggacggcatccgagtgggtcatgcagtgctggccatcaatggcatggacgtgaatggcaggtacacggccgacgggaaagaggtgctggagtatctgggtaaccctgctaattacccggtgtccattcgatttggccggccccgcctcacttctaatgagaagcttatgctggcctccatgttccactcgctctttgccatcggctcccagctgtctcctgaacagggaagctcaggcattgagatgctggagacagacacattcaaattgcactgctaccagacactgacagggatcaagtttgtggttctagcagatcctaggcaagctggaatagattctcttctccgaaagatttatgagatttactcagactttgccctcaagaatccattctattccttagaaatgcctatcaggtgtgagctctttgaccagaacctgaagctagctctggaggtggcagagaaggctggaacttttggacctgggtcataggctgaacctgttatggacccccaaattctgagagttcctgcaacaagaatactgctgttgacactccagtggaaatcccagcagccttgttagtgcacttgaaagtgggagaatgctgaccctgatgacttgtactgattcctgagccttaacactgtgctctttccttctgtatataccatggtcttactttccaactctgtacagatttatttatggaggagctaggtccataaatgttgtaataaatattcctttgatcttggtgtttgcaatctgtcttaatcgatggttttgggggaaagatacaggaagtgagtcaaaaatggttagggaattctgggaagatgattatgtgctagtaaaaaacataacaaatatgtgttcattaaataaatgaacataagattttgaagcatgagcattggatctagtcccagaattgctgctgatttcctggggtcctggggtggtggcagcagtggtggtggctgttatgatgatgatgatgatggaacatatttcaagcacttacagccaggcattcctgctttatctcacttgatcttcaccctaactccagggggtacattctgttacagataagagatttagcagactttctgcctcaaagtttccaagctagttactgacagtctgggtttgaaccaggctttctggctacacactcagtaaaccactgttacacttcttccctccatcaagttatttaat

SEQ ID NO: 31863 - DNA, 6226 bp, Homo sapiens
ggcctcaacatggcggttccggccgggcagtgaccaaggttttgccgtccgaaggactaagtggtgactgtcggcgtctccacctatcggggtggaatgcgagcacgcggggacgagcgctgagaagcggcggtgacgggaaggggggggtcagtggattgtgccccagaaaccgaagcggcggcgtctgttccttcttgtttctaggctccagtgcgttcggggccccgcccggccgggccaggccggcgggcggcggcggtagctgctgcagccgcaggataacctcgcagggtgggccggagggcgggcgccgccgctgcctgtgctgcggcgatggcccagtgtgtacaatcagtgcaggagctaatcccggactccttcgtcccctgtgtcgctgcgctgtgcagcgacgaagccgagcggctcactcgtctcaatcacctcagcttcgcggagctgcttaagcccttctcccgcctcacttccgaggttcacatgagagatcctaataatcaacttcacgtaattaaaaatttgaagatagcagtaagcaacattgtcacccagccacctcagcctggagccatccggaagcttttgaatgatgttgtttctggcagtcagcctgcagaaggattagtagctaatgtgattacagcaggagattatgaccttaacatcagtgccactactccatggtttgagtcttacagagaaacctttcttcagtcgatgccagcattggatcatgaatttctgaaccactatttagcatgtatgttggtagcgtcatctagtgaagctgaacctgtggaacagttttcaaagttgtcacaagaacagcatcgaattcagcacaacagtgattattcctaccccaagtggtttataccaaatacacttaaatactatgtacttttacatgatgtaagtgcaggagatgaacagagagctgaatcaatttatgaagaaatgaaacagaaatatggaactcagggttgctatttacttaaaattaattctcgaacatctaatcgagcatcagatgaacagataccagatccttggagtcagtatctccagaaaaatagtattcaaaaccaggaatcatatgaagatggcccttgtactataacttcaaataagaattctgataataacttgctttcattggatggattagataacgaagtcaaagatggcttaccaaataactttagagctcacccacttcagttggagcaatccagtgacccttctaacagtattgatggcccagatcatctaagatctgcttcatcgttacatgaaacaaagaaaggaaatactggaataattcatggtgcatgtttaacacttactgatcatgatagaattcgacagtttatacaagagttcacatttcggggccttttgccacatatagagaaaacaattaggcaattaaacgatcagctaatatcaagaaaaggtttgagtcgatctctattttctgcaactaaaaaatggtttagtggcagtaaagttccagaaaagagcattaatgacctgaaaaatacatctggcttgctgtatccgccggaagcaccagaacttcaaatcaggaaaatggctgacttatgttttttggtgcagcattatgatttggcttacagttgctatcatactgcaaagaaagattttcttaatgatcaagcaatgctttatgcagctggtgccttggaaatggcagcagtgtctgcttttcttcaaccaggagcacctaggccatatcctgctcattacatggatacagcaattcagacatacagagatatctgcaagaatatggtgttggctgaaagatgtgtgttgcttagtgctgaacttttaaaaagccaaagcaaatattcagaggctgcagctctcctaatacggttgaccagtgaggattctgatcttcgaagtgcacttcttttggaacaggcagcacattgctttataaacatgaaaagtcccatggttagaaaatatgcatttcatatgatattggcaggccatcgatttagtaaagcagggcagaaaaagcatgctttacgctgttattgtcaagccatgcaagtttacaaaggaaaaggctggtctcttgcagaggatcacattaatttcactattgggcgccagtcctatactcttagacagctggataatgctgtgtctgcttttaggcatattctaattaatgaaagtaaacaatctgctgctcaacagggggctttcctcagagaatatctttatgtttacaagaatgtaagtcagctgtcaccagatggtcctttgccacagcttcctttaccgtatattaacagttcagcaacacgggttttttttggccatgacagacgaccagcggatggtgaaaaacaagcagctactcatgtaagtcttgatcaagaatatgattctgaatcctctcagcagtggcgagaacttgaggaacaagttgtttctgtggttaacaaaggagtaattccatccaattttcatcccacacaatactgtttgaacagttactcagataattcaagatttccacttgcagttgtagaagaaccaattacagtggaagtggcttttagaaaccctttgaaagttctacttttgttgactgatttgtcattgctttggaagtttcatcctaaagatttcagtggaaaggataatgaagaagttaaacaactagttacaagtgaacctgaaatgattggagctgaagttatttcagagttcttaattaatggcgaagaatcaaaagtggcaagactaaagctctttccccatcacataggggagctgcatattctgggagttgtttataatcttggcactattcagggctctatgacagtagatggcattggtgctcttcccggatgtcacacaggaaaatattccttgagtatgtcagtccgagggaagcaggatttagaaattcaaggtcctcgacttaacaacacaaaagaagagaaaacatctgttaaatatggccctgatcgacgtttagatcccataatcacagaagaaatgccactgttggaggtgttctttatacattttcctacagggcttctctgtggagaaatccgaaaagcatatgtagaatttgtcaatgtcagcaaatgtccacttactggattgaaggttgtttctaaacgtccagagttctttactttcggtggtaatactgctgttctaacaccactaagtccctcagcttctgagaattgtagtgcttacaagactgttgtgacagatgctacctctgtgtgtacagcactcatatcatcagcttcttctgtagactttggcattggcacaggaagtcaaccagaggtgattcctgttccccttcctgacactgttcttctacccggagcctcagtgcagctgccaatgtggttacgtgggcctgatgaagaaggtgtccatgaaattaactttttgttttactatgaaagtgtcaaaaagcagccaaaaatacggcacagaatattaagacacactgcaattatttgtaccagtcggtctttaaatgtacgggccactgtctgcagaagtaattctcttgaaaatgaagaaggcagaggaggcaatatgctagtctttgtggatgtggaaaataccaatactagtgaagcaggcgttaaggaattccacatagtgcaagtatcaagtagtagcaaacactggaagttacagaaatctgtaaatctttctgaaaacaaagataccaaacttgccagtagggagaagggaaagttttgctttaaggcaataagatgtgagaaagaagaagcggccacacagtcctctgaaaaatatacctttgcagatatcatctttggaaatgaacagataataagttcagcaagcccatgtgcagacttcttttatcgaagtttatcttctgaattgaaaaaaccacaagctcacttgcctgtgcatacagaaaaacagtcaacagaggatgctgtgagattgattcaaaaatgcagtgaggtagatttgaatattgtcatattatggaaggcatacgttgtggaagacagtaaacagcttattttggaaggtcaacatcatgttattcttcgcactataggaaaagaagccttttcatatcctcagaaacaggagccaccagaaatggaactattgaaatttttcaggccagaaaacattacagtttcctcaaggccatcagtagagcagctttctagtctcattaaaacgagtcttcactacccagaatcatttaatcatccatttcatcaaaaaagcctttgtttagtaccagtcactcttttactttccaattgttctaaggctgatgtagatgtcatagttgatcttcggcataaaacaacaagtccagaagcactggaaatccatggatcattcacatggcttggacaaacacagtataaacttcaacttaaaagccaggagattcacagtctgcagctgaaagcatgctttgttcatacaggtgtttataaccttggaactcctagggtatttgccaagttatcggaccaagttacagtgtttgaaacaagtcagcagaattccatgcctgccctgatcatcatcagtaatgtgtgacaacttggaaatttgtactgaaatccacaataatcagtttttgctggatgggttttacagcagtatttgatatacctaacttgttatggaggttgattgatatctgatccctgcaaaatactttgacttgtcattttgttgatgatgcaaagcacgttggactgagaatacttaacattctttttctgtatttctttaaaccctgagaataatttacatgctcataatacaggatatcagcatatttgtgcaccttattaagccccatcttaagaaaacacaaagtctaagtctgctgttacaacttgtcaatggtatacgaatattaggagatgattctgagaaaggaaaggccttgttggcagtactcctgttaagccattagtctctaaattccagctttactgtgaagttctatagagtgttaaatacaaattttcctgtcttgcttcacacagttccttaaaatcagttttgaactttggtcatagagtcttcatatttcagtatttggtggtccctatgacttatacataactttgtaaaaagaaaaaaaaattttttctgatgctttgaatatagttttgaaaggagttttgacttttttcccctcattcatctcagtatagagtgcgctatttcacaatacgatttttgtcattaaaattaccatattctttattatataacgttaactattgagttgatctgtttaaaatataaatctcaagttaattaaaaataagcttttcaaaaatgtattatatttataacaaatatactgtaaatagaataaagacatgctattcactgtatagcgtattagtatctgttgattagaaagtctggtttcaaaatatttttttattcagagaatgggcatttggacataagaaatttcaattcagccctgctgcagatagagaaatgggagcaaggttgtttcaatgaatatctcttgtcattggagaaggagggaagacagggtgtaggagtgggtggcagggagtacaagagccagggtcagtcaagtctggagcagatggggtccttgtgccattgacagctaccatggtttgttccagtctcaatctcggcactaatcggagcagactgcaccaaagtggggagagatcaaaagaccccgttttcagactgaagattccaaacctgtacttggaacaactcttcttgagagatgggtggctagtctgtgtgcctctctgcaactgctgcttatgcttctggatcttaagtgggtctctggcttttcagctccttccactctgtgtcttagcaggtgtgggacaagttggagaggaaggtcacattctaaggacactcatttccttcttgagagtttagggccatgggcttataaaaagtctgaggaggaaagacaagaatgaggaggcataatcacagtggtatctcatatttaaaccactcagctgaatattaaattgaaccgattgttaaacagacactaataaaaaaattaaactatataaacctacaactgaatatattaaaaataaaggtaataaagcactcaaaattacttcctgaatattactcagga

SEQ ID NO: 31864 - DNA, 4272 bp, Homo sapiens
agcgccggctcggccgccagtaggaagcgccagcccagagcctgggaagtggccgcagaggctgctcggccccgctgcccgccaggtcgtgggctcccgctccgggcccggggccaccggctgtggacttcaaaatgagcgtccctgactacatgcagtgtgctgaggaccaccagacgctgctcgtggtggtccagcctgtgggcatcgtctccgaggagaacttcttcaggatctataagaggatttgctctgtgagtcagatcagcgtgcgggactcccagcgagtcctctacatccgctacaggcaccactacccacccgagaacaacgagtggggtgacttccagacccaccgcaaagtcgtgggcctcatcaccatcacagactgcttctcggccaaggactggccacagacctttgagaagttccacgtgcagaaggagatctacggctccacactgtatgactcccggctctttgtcttcgggctgcagggggagatcgtggagcagccgcgcaccgacgtggctttctaccccaactacgaggactgccagacggtggagaagagaatcgaggacttcatcgagtcactgttcatcgtgctggagtccaagcgtctggacagagccacagacaagtctggggataagatcccccttctctgtgtcccgtttgagaaaaaggactttgtaggactggacacagacagcagacattacaagaagcggtgccaaggccgcatgcggaagcacgtgggggacctgtgcctgcaggcagggatgctgcaggactccctggtgcattaccacatgtcggtggagctgctgcgttctgtgaatgactttctgtggcttggagctgccctggaaggattgtgttcagcttctgtcatctatcactatcctggtggaactggtgggaagagtggagctcggaggttccagggcagcacccttcctgctgaagcagccaatagacaccggccaggtgccctcaccaccaatggcatcaaccctgacaccagtactgagatcggacgtgctaagaactgccttagccctgaagacataattgacaagtataaagaggcgatttcctattacagcaagtataagaatgcgggagtgattgagttggaagcgtgcatcaaggctgtacgtgtccttgcaattcagaaacggagcatggaagcatcagaatttcttcagaatgcagtttacattaaccttcgacagctttctgaggaagagaaaattcagcgctacagcatcctctccgagctctatgagctgatcggcttccatcgcaagtctgcgttcttcaagcgcgtggccgccatgcagtgcgtggccccaagcatcgcggagcctgggtggagggcctgctacaaactcctcctggaaacgctgcccggctacagtctgtcgctggatcccaaagatttcagcagaggcacgcacagaggctgggctgcggtccagatgcgtttgctccatgaattggtctacgcctcccgaaggatggggaaccctgccctctctgtcagacacctgtccttccttctacagaccatgctggacttcttgtcggatcaggaaaagaaagatgtggcccaaagcctagagaactatacgtccaagtgtcctgggaccatggagcccatcgccctccctggcggcctcaccctgccaccggtgcccttcaccaagcttcccatcgtcaggcatgtgaaactattgaaccttcctgctagcctccggccacacaaaatgaaaagcttgctgggtcagaacgtgtcaaccaaaagtcctttcatctattcaccaattatcgcacacaaccgtggagaagagcggaacaagaaaatagatttccagtgggttcaaggagatgtgtgtgaagttcagctgatggtatataacccaatgccgtttgaacttcgagttgaaaacatggggctgctcaccagcggagtggagttcgagtctctccctgcggcgctttctcttccggctgaatctggtctgtacccagtgacgctcgtcggggtcccgcagacgactggaacgattactgtgaacggttaccataccacggtcttcggtgtgttcagtgactgtttgctggataacctgccgggaataaaaaccagtggctccacagtggaagtcattcccgcgttgccaagactgcagatcagcacctctctgcccagatctgcacattcattgcaaccttcttctggtgatgaaatatctactaatgtatctgtccagctttacaatggagaaagtcagcaactaatcattaaattggaaaatattggaatggaaccattggagaaactggaggtcacctcgaaagttctcaccactaaagaaaaattgtatggcgacttcttgagctggaagctagaggaaacccttgcccagttccctttgcagcctgggaaggtggccacgttcacaatcaacatcaaagtgaagctggatttctcctgccaggagaatctcctgcaggatctcagtgatgatggaatcagtgtgagtggctttcccctgtccagtccttttcggcaggtcgttcggccccgagtggagggcaaacctgtgaacccacccgagagcaacaaagcaggcgactacagccacgtgaagaccctggaagctgtcctgaatttcaaatactctggaggcccgggccacactgaaggatattacaggaatctctccctggggctgcatgtagaagtcgagccgtctgtatttttcacccgagtcagcaccctcccagcaaccagtacccggcagtgtcacctgctcctggatgtcttcaactccaccgagcatgagctgaccgtcagcaccaggagcagcgaggcactcatcctgcacgccggcgagtgccagcgaatggctattcaagtggacaagttcaactttgagagtttcccggagtcccctggggagaaggggcaatttgcaaaccccaagcagctggaggaagagcggcgggaagcccgaggcctggagatccacagcaagctgggcatctgctggagaatcccctccctgaagcgcagtggcgaggcgagtgtggaaggactcctgaaccagctcgtcctggagcacctgcagctggcgcctctgcagtgggatgtgctggtggacggacagccatgtgaccgcgaggctgtggcggcctgccaggtgggcgaccccgtgcgcctggaggtgcggctgaccaaccggagcccgcgcagcgtagggcccttcgccctcactgtggtccccttccaggaccaccagaacggcgtgcacaactacgacctgcacgacaccgtctccttcgtgggctccagcaccttctacctcgacgcggtgcagccgtccggccagtcggcctgcctcggggccctcctcttcctctacacgggagacttcttcctccacatccggttccacgaggacagcaccagcaaggagctgccaccctcttggttctgcctgcccagtgtgcacgtgtgtgccctggaggcgcaggcctgagcccgcctacttccgtccctctttctgcagggccagaggtgaccctgcctggcctcccacaccccctgcaatgagcaaggccttcactgcagccccatctcctcctcctcccccagacccctcccagccctctcctcctgttcctcctgtagcatctttgctgggctacgcagaagccccggacatggcagccccaccccatgccacgccccttcctacactgttccctggaccatacacaggctgaagcagaggaaatcccaaagcgggtgcccatccagcccaggtcccaggatccctgcacccatttctgtgacctggggccccagccgtgctgtgctgctcatcccagcagagggacctccctcgtccagcgacttccctttggccatagaaagaaatggtgagcatgagactgggcacagcctgagggcgtgggcagcttcccaccctccctgggccttggaatcccccaaggctggttttcttcctggagacccccatgggcaacttggcaggagagatggtgccgtaggaggtcgtggatggttgatgccaagagaggccctccacccgtggtgggcaaatgtccaggcctgggctggcagcccagggctgtttctgggtgctccctggccccagggtggcgtctggttaccatggctgtgtgtgtccatgtctgcaagcagttcttcaataaatggcctgcctccccctc

SEQ ID NO: 31865 - DNA, 4474 bp, Homo sapiens
aaagtcgggagtgccatggtgccagctggggatcaagaccgcgcgccacacagggggaagccggcccaggctggggctcgcacctcacgtgcctcccgggccctgcgatcctggaggcgctcccaggccgcgcgcgccacggtcacccacccacgtggggggcacgaccgtgggagtcacggggggtaccgtgagggtcacagggggtgccgcagggatccacagtgggcttccgcggggcctccacccctgagcttcacagaggaagtgaaatttgagctgcgcgccctgaaggactgggacttcaaaatgagcgtccctgactacatgcagtgtgctgaggaccaccagacgctgctcgtggtggtccagcctgtgggcatcgtctccgaggagaacttcttcaggatctataagaggatttgctctgtgagtcagatcagcgtgcgggactcccagcgagtcctctacatccgctacaggcaccactacccacccgagaacaacgagtggggtgacttccagacccaccgcaaagtcgtgggcctcatcaccatcacagactgcttctcggccaaggactggccacagacctttgagaagttccacgtgcagaaggagatctacggctccacactgtatgactcccggctctttgtcttcgggctgcagggggagatcgtggagcagccgcgcaccgacgtggctttctaccccaactacgaggactgccagacggtggagaagagaatcgaggacttcatcgagtcactgttcatcgtgctggagtccaagcgtctggacagagccacagacaagtctggggataagatcccccttctctgtgtcccgtttgagaaaaaggactttgtaggactggacacagacagcagacattacaagaagcggtgccaaggccgcatgcggaagcacgtgggggacctgtgcctgcaggcagggatgctgcaggactccctggtgcattaccacatgtcggtggagctgctgcgttctgtgaatgactttctgtggcttggagctgccctggaaggattgtgttcagcttctgtcatctatcactatcctggtggaactggtgggaagagtggagctcggaggttccagggcagcacccttcctgctgaagcagccaatagacaccggccaggggcacaggaagttctcattgatccaggtgccctcaccaccaatggcatcaaccctgacaccagtactgagatcggacgtgctaagaactgccttagccctgaagacataattgacaagtataaagaggcgatttcctattacagcaagtataagaatgcgggagtgattgagttggaagcgtgcatcaaggctgtacgtgtccttgcaattcagaaacggagcatggaagcatcagaatttcttcagaatgcagtttacattaaccttcgacagctttctgaggaagagaaaattcagcgctacagcatcctctccgagctctatgagctgatcggcttccatcgcaagtctgcgttcttcaagcgcgtggccgccatgcagtgcgtggccccaagcatcgcggagcctgggtggagggcctgctacaaactcctcctggaaacgctgcccggctacagtctgtcgctggatcccaaagatttcagcagaggcacgcacagaggctgggctgcggtccagatgcgtttgctccatgaattggtctacgcctcccgaaggatggggaaccctgccctctctgtcagacacctgtccttccttctacagaccatgctggacttcttgtcggatcaggaaaagaaagatgtggcccaaagcctagagaactatacgtccaagtgtcctgggaccatggagcccatcgccctccctggcggcctcaccctgccaccggtgcccttcaccaagcttcccatcgtcaggcatgtgaaactattgaaccttcctgctagcctccggccacacaaaatgaaaagcttgctgggtcagaacgtgtcaaccaaaagtcctttcatctattcaccaattatcgcacacaaccgtggagaagagcggaacaagaaaatagatttccagtgggttcaaggagatgtgtgtgaagttcagctgatggtatataacccaatgccgtttgaacttcgagttgaaaacatggggctgctcaccagcggagtggagttcgagtctctccctgcggcgctttctcttccggctgaatctggtctgtacccagtgacgctcgtcggggtcccgcagacgactggaacgattactgtgaacggttaccataccacggtcttcggtgtgttcagtgactgtttgctggataacctgccgggaataaaaaccagtggctccacagtggaagtcattcccgcgttgccaagactgcagatcagcacctctctgcccagatctgcacattcattgcaaccttcttctggtgatgaaatatctactaatgtatctgtccagctttacaatggagaaagtcagcaactaatcattaaattggaaaatattggaatggaaccattggagaaactggaggtcacctcgaaagttctcaccactaaagaaaaattgtatggcgacttcttgagctggaagctagaggaaacccttgcccagttccctttgcagcctgggaaggtggccacgttcacaatcaacatcaaagtgaagctggatttctcctgccaggagaatctcctgcaggatctcagtgatgatggaatcagtgtgagtggctttcccctgtccagtccttttcggcaggtcgttcggccccgagtggagggcaaacctgtgaacccacccgagagcaacaaagcaggcgactacagccacgtgaagaccctggaagctgtcctgaatttcaaatactctggaggcccgggccacactgaaggatattacaggaatctctccctggggctgcatgtagaagtcgagccgtctgtatttttcacccgagtcagcaccctcccagcaaccagtacccggcagtgtcacctgctcctggatgtcttcaactccaccgagcatgagctgaccgtcagcaccaggagcagcgaggcactcatcctgcacgccggcgagtgccagcgaatggctattcaagtggacaagttcaactttgagagtttcccggagtcccctggggagaaggggcaatttgcaaaccccaagcagctggaggaagagcggcgggaagcccgaggcctggagatccacagcaagctgggcatctgctggagaatcccctccctgaagcgcagtggcgaggcgagtgtggaaggactcctgaaccagctcgtcctggagcacctgcagctggcgcctctgcagtgggatgtgctggtggacggacagccatgtgaccgcgaggctgtggcggcctgccaggtgggcgaccccgtgcgcctggaggtgcggctgaccaaccggagcccgcgcagcgtagggcccttcgccctcactgtggtccccttccaggaccaccagaacggcgtgcacaactacgacctgcacgacaccgtctccttcgtgggctccagcaccttctacctcgacgcggtgcagccgtccggccagtcggcctgcctcggggccctcctcttcctctacacgggagacttcttcctccacatccggttccacgaggacagcaccagcaaggagctgccaccctcttggttctgcctgcccagtgtgcacgtgtgtgccctggaggcgcaggcctgagcccgcctacttccgtccctctttctgcagggccagaggtgaccctgcctggcctcccacaccccctgcaatgagcaaggccttcactgcagccccatctcctcctcctcccccagacccctcccagccctctcctcctgttcctcctgtagcatctttgctgggctacgcagaagccccggacatggcagccccaccccatgccacgccccttcctacactgttccctggaccatacacaggctgaagcagaggaaatcccaaagcgggtgcccatccagcccaggtcccaggatccctgcacccatttctgtgacctggggccccagccgtgctgtgctgctcatcccagcagagggacctccctcgtccagcgacttccctttggccatagaaagaaatggtgagcatgagactgggcacagcctgagggcgtgggcagcttcccaccctccctgggccttggaatcccccaaggctggttttcttcctggagacccccatgggcaacttggcaggagagatggtgccgtaggaggtcgtggatggttgatgccaagagaggccctccacccgtggtgggcaaatgtccaggcctgggctggcagcccagggctgtttctgggtgctccctggccccagggtggcgtctggttaccatggctgtgtgtgtccatgtctgcaagcagttcttcaataaatggcctgcctccccctc

SEQ ID NO: 31866 - DNA, 4297 bp, Homo sapiens
agcgccggctcggccgccagtaggaagcgccagcccagagcctgggaagtggccgcagaggctgctcggccccgctgcccgccaggtcgtgggctcccgctccgggcccggggccaccggctgtggacttcaaaatgagcgtccctgactacatgcagtgtgctgaggaccaccagacgctgctcgtggtggtccagcctgtgggcatcgtctccgaggagaacttcttcaggatctataagaggatttgctctgtgagtcagatcagcgtgcgggactcccagcgagtcctctacatccgctacaggcaccactacccacccgagaacaacgagtggggtgacttccagacccaccgcaaagtcgtgggcctcatcaccatcacagactgcttctcggccaaggactggccacagacctttgagaagttccacgtgcagaaggagatctacggctccacactgtatgactcccggctctttgtcttcgggctgcagggggagatcgtggagcagccgcgcaccgacgtggctttctaccccaactacgaggactgccagacggtggagaagagaatcgaggacttcatcgagtcactgttcatcgtgctggagtccaagcgtctggacagagccacagacaagtctggggataagatcccccttctctgtgtcccgtttgagaaaaaggactttgtaggactggacacagacagcagacattacaagaagcggtgccaaggccgcatgcggaagcacgtgggggacctgtgcctgcaggcagggatgctgcaggactccctggtgcattaccacatgtcggtggagctgctgcgttctgtgaatgactttctgtggcttggagctgccctggaaggattgtgttcagcttctgtcatctatcactatcctggtggaactggtgggaagagtggagctcggaggttccagggcagcacccttcctgctgaagcagccaatagacaccggccaggggcacaggaagttctcattgatccaggtgccctcaccaccaatggcatcaaccctgacaccagtactgagatcggacgtgctaagaactgccttagccctgaagacataattgacaagtataaagaggcgatttcctattacagcaagtataagaatgcgggagtgattgagttggaagcgtgcatcaaggctgtacgtgtccttgcaattcagaaacggagcatggaagcatcagaatttcttcagaatgcagtttacattaaccttcgacagctttctgaggaagagaaaattcagcgctacagcatcctctccgagctctatgagctgatcggcttccatcgcaagtctgcgttcttcaagcgcgtggccgccatgcagtgcgtggccccaagcatcgcggagcctgggtggagggcctgctacaaactcctcctggaaacgctgcccggctacagtctgtcgctggatcccaaagatttcagcagaggcacgcacagaggctgggctgcggtccagatgcgtttgctccatgaattggtctacgcctcccgaaggatggggaaccctgccctctctgtcagacacctgtccttccttctacagaccatgctggacttcttgtcggatcaggaaaagaaagatgtggcccaaagcctagagaactatacgtccaagtgtcctgggaccatggagcccatcgccctccctggcggcctcaccctgccaccggtgcccttcaccaagcttcccatcgtcaggcatgtgaaactattgaaccttcctgctagcctccggccacacaaaatgaaaagcttgctgggtcagaacgtgtcaaccaaaagtcctttcatctattcaccaattatcgcacacaaccgtggagaagagcggaacaagaaaatagatttccagtgggttcaaggagatgtgtgtgaagttcagctgatggtatataacccaatgccgtttgaacttcgagttgaaaacatggggctgctcaccagcggagtggagttcgagtctctccctgcggcgctttctcttccggctgaatctggtctgtacccagtgacgctcgtcggggtcccgcagacgactggaacgattactgtgaacggttaccataccacggtcttcggtgtgttcagtgactgtttgctggataacctgccgggaataaaaaccagtggctccacagtggaagtcattcccgcgttgccaagactgcagatcagcacctctctgcccagatctgcacattcattgcaaccttcttctggtgatgaaatatctactaatgtatctgtccagctttacaatggagaaagtcagcaactaatcattaaattggaaaatattggaatggaaccattggagaaactggaggtcacctcgaaagttctcaccactaaagaaaaattgtatggcgacttcttgagctggaagctagaggaaacccttgcccagttccctttgcagcctgggaaggtggccacgttcacaatcaacatcaaagtgaagctggatttctcctgccaggagaatctcctgcaggatctcagtgatgatggaatcagtgtgagtggctttcccctgtccagtccttttcggcaggtcgttcggccccgagtggagggcaaacctgtgaacccacccgagagcaacaaagcaggcgactacagccacgtgaagaccctggaagctgtcctgaatttcaaatactctggaggcccgggccacactgaaggatattacaggaatctctccctggggctgcatgtagaagtcgagccgtctgtatttttcacccgagtcagcaccctcccagcaaccagtacccggcagtgtcacctgctcctggatgtcttcaactccaccgagcatgagctgaccgtcagcaccaggagcagcgaggcactcatcctgcacgccggcgagtgccagcgaatggctattcaagtggacaagttcaactttgagagtttcccggagtcccctggggagaaggggcaatttgcaaaccccaagcagctggaggaagagcggcgggaagcccgaggcctggagatccacagcaagctgggcatctgctggagaatcccctccctgaagcgcagtggcgaggcgagtgtggaaggactcctgaaccagctcgtcctggagcacctgcagctggcgcctctgcagtgggatgtgctggtggacggacagccatgtgaccgcgaggctgtggcggcctgccaggtgggcgaccccgtgcgcctggaggtgcggctgaccaaccggagcccgcgcagcgtagggcccttcgccctcactgtggtccccttccaggaccaccagaacggcgtgcacaactacgacctgcacgacaccgtctccttcgtgggctccagcaccttctacctcgacgcggtgcagccgtccggccagtcggcctgcctcggggccctcctcttcctctacacgggagacttcttcctccacatccggttccacgaggacagcaccagcaaggagctgccaccctcttggttctgcctgcccagtgtgcacgtgtgtgccctggaggcgcaggcctgagcccgcctacttccgtccctctttctgcagggccagaggtgaccctgcctggcctcccacaccccctgcaatgagcaaggccttcactgcagccccatctcctcctcctcccccagacccctcccagccctctcctcctgttcctcctgtagcatctttgctgggctacgcagaagccccggacatggcagccccaccccatgccacgccccttcctacactgttccctggaccatacacaggctgaagcagaggaaatcccaaagcgggtgcccatccagcccaggtcccaggatccctgcacccatttctgtgacctggggccccagccgtgctgtgctgctcatcccagcagagggacctccctcgtccagcgacttccctttggccatagaaagaaatggtgagcatgagactgggcacagcctgagggcgtgggcagcttcccaccctccctgggccttggaatcccccaaggctggttttcttcctggagacccccatgggcaacttggcaggagagatggtgccgtaggaggtcgtggatggttgatgccaagagaggccctccacccgtggtgggcaaatgtccaggcctgggctggcagcccagggctgtttctgggtgctccctggccccagggtggcgtctggttaccatggctgtgtgtgtccatgtctgcaagcagttcttcaataaatggcctgcctccccc

SEQ ID NO: 31867 - DNA, 5293 bp, Homo sapiens
gataaattcactcctcccccagttcccagcaagccctgagatgaacagcagactttttgttccactttaatttttaggcaaaaccgaatgcccatcacaaagccccgttctccttgctactccccttcccccaacctagaggtatcacatttttgggtgcgtcattttctgtttggggtggcttaacaagatgagctgatagggttcccaggctgcctggagttacataacccattgtgcttccaggacagctcacaatcttaggatttgccctaacaagcaaactcagaaaactgctgaggaaggcacgggagggtggctgtgcgaggtactgccggggctgagctctcatggaggctctctctgttctctgaagtgcctttggagtttatgtctgcacatggcattggtttttcaattcgggcagcccgtcagggctcagcctctgccaggactctgccacggcaagctcattcggacaaacgcctgtgatgtgtgcaacagcaccgatcttccggaagtcgagatcattagcctgctggaggagcagctgccccattataagttaagagccgacaccatctacggttatgaccacgacgactggctccatacacctctcatttctccagatgccaacattgacctcacaaccgagcaaattgaagagacgttaaaatacttccttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcactgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttccgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccatgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagtttcagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatgg

SEQ ID NO: 31868 - DNA, 4620 bp, Homo sapiens
gggtgatgctgggccaggagctttgtgtacacccctccacttcagctgagccagggcatgtctgcggcccaggccagggcgcagtgtgtgccctgggggcccaggcctgcatggctcctctgggtagggggtcgggggcacccccaaggatggtcccttagggtgatgttttggctttggggtgacttcagcaatgtccctgcgagacaagggcggggaagaagaatgttttgaatacgactgccaggatgaagagaggaagccaacccacaggcagcatgacacccaggacctcttggaagaggttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcactgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttccgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcaggtgagaggtcccaagcacgtgtgactgtctcaggcagcagaagttacccgagccggcctcaggcttccccagaggagatgcaggagccgccagcggccacggaggaggaggaggaggaggaggaggaggaggggtctggtgagggcaccacgataagtcctgtaaacttggcacctttcccggaggcagagttttgggccattctcacctctgttccaggcaccatccgtagtggttctctgtctgtagcttccgctcgtctgtgtgggtgatgattaaagcattctcattgcacagttctgtttttaaatacagagtctgatgcctcctatttgtaacaatgggtgtagctcccctgcccatcttggaggtgcatggcccatcagggatctttaaagtgggagcaggaaaggctgctaaaaaaaaaaaaaaaaaaaaaagtgggcttttgggtccctgaaaacatcagtgcccttcttcctggtctgggtgtctccctgagtctaaggggaagattctcaagtcccctggtgatttccaagtggagctgagcagttttagggaaattgagtgctgggtcattcagaaggtaaatgagatcatctgttacctgtacgctgtattaaaatagaaccaggaaaggctcaggatttcagacatttcatcagccttttcactttcccagcttcaatggaggtatatatgtcattttcttttcagcttacacatgtgttcaaagtggatttttaaaaagtgttttagcaatactccttaaccaaataaaccttcggagaacgtcactaagcttttccagagagaagaccctagatgaagttggaaaagagctctggctgactccacccactgtccccaagcattaaaggtgtggccatgagtttacagaattacccacattccagttgccactgggatgaaaagctttgtgctcagagctctgggaatcatgggatcacatggttactgtttaccccaacagcatgctctgtctagactggacctcccagccccttgtgttgggaaggcaaagcttttgtggagtcaggggggagactgagaaaaaatgaattaaccctgtgttgtcatcctcatgacattcctgaggattcaccaggttagaagtgaggacgtttatctttgtgattcataattttcatttgtgaaggccacaacactccccttgaaatacagggcaggaaagagctgaggttcttggtggtgtctcccattcccctggctaatttcagacagctgtggtcaagggattttacttgggatcaacttttccttttttccttgacattaattttagagaagtcatcaagtcatgtgatttgtttagcacataggtttatttatggtttgattttttttaggcagttatattactagattaagcttgtgagggaatgaaaatgttttttatttgttatctacacactcgaaaaagagaaaccagctgcggtactgtcccatttttgtcatcagcaccagtgtccgtcaggaaggcaggtggtggtgcagaaacatgatgcctggctgattttcgtggctaaaggggtaggccttatgttgattgggatgctcccctacagccttacaggtagaatagaaggtgagttctggaagtgcaaagaagcaccattaagtgcatcttctagaagttgtacagaaggactaaagcttatcaagtcaacaaagaacttaccttggaggatagagagagagaagggaccaattatgaggactgacatcctggccactctccttaaaataaacactgacatttttcttgcttgttctctctgtactcaaacctgtggcaaattcatcctagcaacgttatttgacgaggggcatgaacatttatagttgaaactgtagaaagggtcaggttggaggtgtgtaataaaaaagaattacctaggttgccaaaggtaatttaggaagggtctgatcatttagatgagagttctttggggcttattttctgggtaaggctcatctttaaaaactggcttcagaggggagaggggagaacaatgaattggctctattttctctattgggaattacaggaccattttgattcttagaatgtaaaaagcatatcgctaagtaaatcatcctggaggtcccaagtagctctatgcctgcaatcatggagacacaggcagacagataagcttcatggggaaggcatggggcatcctctgtcttgggatttgtatccatggtggtctggtccctgccttttaatccgtcctctacgcttgggcttttctgttaccaaacagcactatcccaggaactattgtctgcctgggaacactcagtagggagacactttggagacaggaggtgatgaacctttttatgtgcagctggtatgatagaaggaaattgggaaaacttgtatgctaggcacttttgtccagagcctgctgtcccatggagaaaaagttttaagcactgaaaaaatttgattaatgtatttaaatgtattatttgaagcatcattcacttgttgatttttacaatcccatgtcttaaaaaggatgaatccatgttattgtattgtaaataatttagatgattaaaatggattgtttaaaaagtt

SEQ ID NO: 31869 - DNA, 5033 bp, Homo sapiens
gggtgatgctgggccaggagctttgtgtacacccctccacttcagctgagccagggcatgtctgcggcccaggccagggcgcagtgtgtgccctgggggcccaggcctgcatggctcctctgggtagggggtcgggggcacccccaaggatggtcccttagggtgatgttttggctttggggtgacttcagcaatgtccctgcgagacaagggcggggaagaagaatgttttgaatacgactgccaggatgaagagaggaagccaacccacaggcagcatgacacccaggacctcttggaagaggttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcactgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttccgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccatgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagtttcagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatggaaaccacactggtattctgatttgtattttgtttttatcttttcatcaaggagacgatctctttatgtaagacttgaaagtgtttagctctttgcaaaattaaatgaaaggcatatacttc

SEQ ID NO: 31870 - DNA, 2835 bp, Homo sapiens
aagcaaactcagaaaactgctgaggaaggcacgggagggtggctgtgcgaggtactgccggggctgagctctcatggaggctctctctgttctctgaagtgcctttggagtttatgtctgcacatggcattggtttttcaattcgggcagcccgtcagggctcagcctctgccaggactctgccacggcaagctcattcggacaaacgcctgtgatgtgtgcaacagcaccgatcttccggaagtcgagatcattagcctgctggaggagcagctgccccattataagttaagagccgacaccatctacggttatgaccacgacgactggctccatacacctctcatttctccagatgccaacattgacctcacaaccgagcaaattgaagagacgttaaaatacttccttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcactgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttccgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagc

SEQ ID NO: 31871 - DNA, 6510 bp, Homo sapiens
cctttggcttccccaattgtgtgggggctgccattgacccggtgtcgccgcagaaccgaggtcgccgagtgatgatgttgtgaagtcgcccgcctgtccctgccacgcccgggcggttgctggcagtgggagcagcggcagcagcttcggctgctgctttcaggctgccgctgcattaggggcttcctgaggaagcgcgggcggacgacagaggatgccgaaccactccagtcatgactgtccaaagtatgataatcacatgagagtgctcgttgctacggatgtcatttgactcatcagagaaaatctgtctaaaagaaaatatccatgtgaccaaatccatttcattattgaatggcttgatggatttcctttactctgattcataccaaagctgtccttctcaaccaaagcaagaaaggatcctgcatgagtcaatcccagaatgcaatttttacatcaccaacaggtgaagaaaacctcatgaatagcaatcacagagactcggagagcatcactgatgtctgctccaatgaggatctccctgaagttgagctggtgagtctgctagaagaacaactaccacagtataggctaaaagtagacactctctttctatatgaaaatcaagactggactcagtctccacaccagcggcagcatgcatctgatgctctctctccagtccttgctgaagagactttccgttacatgattctaggcacagacagggtggagcagatgaccaaaacttacaatgacatcgacatggttacacatctcctggcagagagggatcgtgatctggaactcgctgctcgaattggacaagctctcttaaagcggaaccatgtcttatctgagcagaacgaatccctggaggagcaattgggacaagcctttgatcaagttaatcagctgcagcatgagctatgcaagaaagatgagttacttcgaatcgtctccattgcttctgaagaaagtgaaactgattccagctgttctacacctcttcggttcaatgagtcctttagcttatctcaagggttgctgcagttggaaatgctgcaagaaaagctcaaggaactggaagaagagaatatggctcttcgatccaaggcttgtcacataaagacagaaactgttacctatgaagaaaaggaacaacagcttgtcagcgactgtgttaaagaacttcgtgaaacaaatgctcagatgtccagaatgactgaagaattgtcagggaagagtgatgagctgattcgataccaagaagagctttcctctcttttgtcacagattgtagaccttcagcacaaacttaaagaacatgtgattgagaaggaagaactaaaacttcacctgcaagcttccaaagatgcccaacggcaactgacaatggagctgcacgagttacaagacaggaatatggagtgtctaggaatgttacatgaatcccaagaagaaataaaggaacttcgtagtagatctggccctactgctcatctctacttctcccaatcatatggagcttttactggggaatctttggcagctgagattgaggggactatgcgtaaaaagctgagtttggatgaggaatcttctctctttaaacaaaaagcccaacagaagcgggtatttgataccgtcaggattgccaatgacacacggggccgctctatctcattcccagctctgttacccattccaggctccaaccgttcaagtgtcatcatgacagcaaaaccttttgagtctggtcttcagcaaacagaggacaaatcactcctgaaccaggggagcagctcagaggaggttgcagggagctcccagaagatgggccaaccaggaccctcaggagatagtgatttggctacagcactgcatcgccttagcttgcgtcgacaaaactatttaagtgagaagcagttctttgctgaagaatggcagcggaagatccaggttctggcagaccagaaggaaggagttagtggctgtgtcaccccgacagagagccttgcctctctctgcaccacccagtcagagatcacagacctcagcagtgccagttgccttcgaggttttatgccagaaaaattacaaattgtcaagccccttgaaggatcacaaactctgtatcactggcagcagcttgctcaaccaaacttgggaaccatccttgatccacgaccaggtgtcattactaaaggctttacccagttgcccggggatgctatttatcacatctcagatttagaagaggatgaagaggagggtattacttttcaggttcagcaacctcttgaagtggaagagaaactttcaacatccaagccagtaacagggatcttcctgccacccattacttcagcaggtggaccagttacagttgcaaccgccaacccaggaaagtgcctgtcgtgcacaaactcaacattcactttcaccacctgtagaatattacatccctctgacatcactcaggttacccccagctctgggttcccttcattatcctgtggaagtagcggtagcagttcatccaacacggctgtgaattctcctgccttgtcctatagactcagcattggtgagtccatcaccaaccgacgagattccactacaaccttcagtagcaccatgagcttggccaaacttctacaagagcgaggcatctctgccaaagtgtaccacagcccaatttcagagaaccccctccagcctctccctaaatccctggctatcccttccacaccaccaaattcaccatctcactcaccttgcccttctcctttaccctttgagcctcgagtgcatctctctgaaaattttttggcctctcgaccagctgagacattcctccaggagatgtatggcttgagaccctcccggaaccctcctgatgttggccagttgaagatgaacttagtggacaggctgaagagactggggatagccagagtggtcaagaaccctggtgcccaagagaatggaagatgccaggaggcagaaattggtcctcaaaaaccagattctgctgtttatttaaattcaggtagcagtttattaggtggactaaggaggaatcagagtcttccagtcataatgggtagctttgctgccccagtttgcacatcctcacccaaaatgggtgtcctgaaggaggactgaggttcagcagttaactgaccttttatacaagttagcacatgaaggatagatatgcactgaaacatgtggtctggtctgacttgagagaaaaggaatgttgcacaagggttgtgaatgtgaaagggggaatggaggaatggaaataaaattgggatgagccctaatggaggaagtcgggcaaattgaaagtataaatgaatgggccatgagtgttcagagggagaaaagaaaggtttaatatactccttcagttgagttttcttgtcttgaacataaaaagtgaatacaaataaattcagtaatactaaaacatacagagatactgaacttgctggcacatttacttctggtaagcataaagcagagagaacccaggttagaaggatgggaagagaaaaggagcagttttattgcttatagaaagccgttctgaggggttggtggggtaagctcagtctattactgagacaatagtgagatggcttatatgtttcccctgttaatatctggttaaattatgtatccatcaaatggtatgctcgcagcattagcaaaattaggagtttcatctttttcattgaatcacaggtggagactcctattttcctttctgttttcaggcctttgagcccctgggagcccaaataccactcaattattttgtatttatgattaataaaagttcattttttaaatttgtatttttatacaacctccaaaaaaaaaaacaactgggtagagggtgggagggatttacttttaagaggcaaaatgtgagtaaattgaaaccaagaaaacttgtttttagaatatttcgtctgaataagtacagtagccaaggaatacaaacataattgcatgtttttaaaaattccttggaggctggaaggggttaagccagaagtgcaatcaataggaattagggaatgttgtatatttatatatgtaaactttttttgtaagaaaagttggtgacaactaaaccaactttttccaaagtgcgctatgcatatttttaatgaaagatgacatgtatttgcacaaaaattctcaggcacattaaattattgtaaactgaagtaaaacccgggtgcttgctttgagattgtggttttttcttcctaatgtaaaataaaataaaacacatctgccttcttgatatttatagaattagagaataaactttttaatgggggagtcaaagctttttctttttctctaaggttctttttttttattcaaactgtatgaaatggcaaagtgaggctctggggttagatttcagcattcagcagttgacacaggctaagaaatggaaagaagtagatctgttttttctcaatgttgctgagcaaagtctgcttctcatcagatgacgtggctttgtctagacagcacgcagttcagaaagaaatgtctttatacaaaagacatgatagagaaaagatgagagaggggactaattattttgtttatgaaaatggcaagtaaattacttgatctttttggtgcttaatttgcaaatgttttgttcctttgtcctgacttaaaggcagttttctgaagaactcttgactcttgctcctatggttcccataggcacacctattcccaggccaaggagagtccttcctctccccttttgaggcatccccgccatccccccacttagagctatgtgctcaaaaagccaacatgaatgcagtggtaaaaatttgttagtttcttatactttttagaatctctcaataaaatttttctaaataaattccacaaaaacaaagggtgaagatggtctctccctttcgttccccttcactcagttgtgctgaggtcaatagagtgtagagtttcagaaaggattccagcaggtttatatgtgaatataagtgtccctgaatggggcaggcattaaatagaagaatccctgctgtttaaatttcccgcatattccaattcacttttaaaaaataccatttgaatttgtatttcataaagtgactctggggtgcttactttagtcaattcttaaaattttttatttgttccctaagaaagtaattactgtttctgttgcctggacagttacagtttccaggaaacatcaggaagtaggaaactgtagggccagagagtagtacaacgttaaattgtccgatttatgtgtattacttaaagctataaattgaactagatcttgccgtgctctgtattgagtataatttgtatacttttttataattaatgactaaatgatcactttggaggcagggtggtgggggtgtattagcagccaaataagcacatctgatcaaaaagaaccaggcttagattttttttaagtacattgatgttgatgttccaccagaaacaccttaagtgtatactgttgtgtaatgtctctagaaaggaatcctgtcttaaaactgggttttgctgttttttgaagtttctacctaaaatcatttttggtatatcctgataatctctataatactagaattgtctgcaaaatatagtaagaagaattggagcctaatagctgattcctcccaatttatctgttatgttttgtcactattcacattttagtcttttctacgataaaaattgtatgtgtactttcatgccagtataggaaacctcaatcttttttttttttcgcctttaagaaggttttcagtgattatacctcaggtatttctgagtgtcctattgtctaataggagaaatatcttcccgagctcagaattaaaagttctcctaaattatgaagatcccaaatcttatgtaaataaccttaggcatgagtccttagggagaagttaatgaccattgttaaagtgcttttttagaaaatgttgtgctgtatgttcttgatttgacataaatgaatagactttggcaagggaggaaataagttaaaaggcagcttacaagagcctattccctataaagggtataattttacacagtactcaaagcttgttatcttttctgaccattttagtacagaattagtacttggtggttactaacatcaacttgtgacatctagaactagggctcttagtgtttagtgggccacttctctgatgtcagatgcatgcagacctgtactccacatgcaacccaacagcagtgcagtgtgataactgagcggtcgcatggcagaggacatccccctcagagtgggcacaagtgccctctagggcagccaggggaatactattgttcgatacctgggatttgactttgtcaaacagctctttgtgcccctatctttgttttgtcaaatgtagatcagttaataaacatgagtagcttgaattttca

SEQ ID NO: 31872 - DNA, 1436 bp, Homo sapiens
gtgaagtcgcccgcctgtccctgccacgcccgggcggttgctggcagtgggagcagcggcagcagcttcggctgctgctttcaggctgccgctgcattaggggcttcctgaggaagcgcgggcggacgacagaggatgccgaaccactccagtcatgactgtccaaagtatgataatcacatgagagtgctcgttgctacggatgtcatttgactcatcagagaaaatctgtctaaaagaaaatatccatgtgaccaaatccatttcattattgaatggcttgatggatttcctttactctgattcataccaaagctgtccttctcaaccaaagcaagaaaggatcctgcatgagtcaatcccagaatgcaatttttacatcaccaacaggtgaagaaaacctcatgaatagcaatcacagagactcggagagcatcactgatgtctgctccaatgaggatctccctgaagttgagctggtgagtctgctagaagaacaactaccacagtataggctaaaagtagacactctctttctatatgaaaatcaagactggactcagtctccacaccagcggcagcatgcatctgatgctctctctccagtccttgctgaagagactttccgttacatgattctaggcacagacagggtggagcagatgaccaaaacttacaatgacatcgacatggttacacatctcctggcagagagggatcgtgatctggaactcgctgctcgaattggacaagctctcttaaagcggaaccatgtcttatctgagcagaacgaatccctggaggagcaattgggacaagcctttgatcaagttaatcagctgcagcatgagctatgcaagaaagatgagttacttcgaatcgtctccattgcttctgaagaaagtgaaactgattccagctgttctacacctcttcggttcaatgagtcctttagcttatctcaagggttgctgcagttggaaatgctgcaagaaaagctcaaggaactggaagaagagaatatggctcttcgatccaaggcttgtcacataaagacagaaactgttacctatgaagaaaaggaacaacagcttgtcagcgactgtgttaaagaacttcgtgaaacaaatgctcagatgtccagaatgactgaagaattgtcagggaagagtgatgagctgattcgataccaagaagagctttcctctcttttgtcacagattgtagaccttcagcacaaacttaaagaagtaggtttattcattcattcaacagatatttgttaagcactcacatagtatcttgcaccatgctaagtgctagatacaataaacaaaataaacattgtccctgcccttttaaaatgccctaatctgattgctgttttaatcatctttatgtcatataagatatcatgaataaatactttcaagtca

SEQ ID NO: 31873 - DNA, 381 bp, Homo sapiens
ggaaatactgaccccataaacctaaatctcacacacggttttggacgtttaaacgaatggatttaacagccttttggaattcagcctgtttgtcatgactgtccaaagtatgataatcacatgagagtgctcgttgctacggatgtcatttgactcatcagagaaaatctgtctaaaagaaaatatccatgtgaccaaatccatttcattattgaatggcttgatggatttcctttactctgattcataccaaagctgtccttctcaaccaaagcaagaaaggatcctgcatgagtcaatcccagaatgcaatttttacatcaccaacaggtgaagaaaacctcatgaatagcaatcacagagactcggagagcatcactg

SEQ ID NO: 31874 - DNA, 3896 bp, Homo sapiens
ggggccgtggaggccgctgggagagtggctctcctttggcttccccaattgtgtgggggctgccattgacccggtgtcgccgcagaaccgaggtcgccgagtgatgatgttgtgaagtcgcccgcctgtccctgccacgcccgggcggttgctggcagtgggagcagcggcagcagcttcggctgctgctttcaggctgccgctgcattaggggcttcctgaggaagcgcgggcggacgacagaggatgccgaaccactccagtcatgactgtccaaagtatgataatcacatgagagtgctcgttgctacggatgtcatttgactcatcagagaaaatctgtctaaaagaaaatatccatgtgaccaaatccatttcattattgaatggcttgatggatttcctttactctgattcataccaaagctgtccttctcaaccaaagcaagaaaggatcctgcatgagtcaatcccagaatgcaatttttacatcaccaacaggtgaagaaaacctcatgaatagcaatcacagagactcggagagcatcactgatgtctgctccaatgaggatctccctgaagttgagctggtgagtctgctagaagaacaactaccacagtataggctaaaagtagacactctctttctatatgaaaatcaagactggactcagtctccacaccagcggcagcatgcatctgatgctctctctccagtccttgctgaagagactttccgttacatgattctaggcacagacagggtggagcagatgaccaaaacttacaatgacatcgacatggttacacatctcctggcagagagggatcgtgatctggaactcgctgctcgaattggacaagctctcttaaagcggaaccatgtcttatctgagcagaacgaatccctggaggagcaattgggacaagcctttgatcaagttaatcagctgcagcatgagctatgcaagaaagatgagttacttcgaatcgtctccattgcttctgaagaaagtgaaactgattccagctgttctacacctcttcggttcaatgagtcctttagcttatctcaagggttgctgcagttggaaatgctgcaagaaaagctcaaggaactggaagaagagaatatggctcttcgatccaaggcttgtcacataaagacagaaactgttacctatgaagaaaaggaacaacagcttgtcagcgactgtgttaaagaacttcgtgaaacaaatgctcagatgtccagaatgactgaagaattgtcagggaagagtgatgagctgattcgataccaagaagagctttcctctcttttgtcacagattgtagaccttcagcacaaacttaaagaacatgtgattgagaaggaagaactaaaacttcacctgcaagcttccaaagatgcccaacggcaactgacaatggagctgcacgagttacaagacaggaatatggagtgtctaggaatgttacatgaatcccaagaagaaataaaggaacttcgtagtagatctggccctactgctcatctctacttctcccaatcatatggagcttttactggggaatctttggcagctgagattgaggggactatgcgtaaaaagctgagtttggatgaggaatcttctctctttaaacaaaaagcccaacagaagcgggtatttgataccgtcaggattgccaatgacacacggggccgctctatctcattcccagctctgttacccattccaggctccaaccgttcaagtgtcatcatgacagcaaaaccttttgagtctggtcttcagcaaacagaggacaaatcactcctgaaccaggggagcagctcagaggaggttgcagggagctcccagaagatgggccaaccaggaccctcaggagatagtgatttggctacagcactgcatcgccttagcttgcgtcgacaaaactatttaagtgagaagcagttctttgctgaagaatggcagcggaagatccaggttctggcagaccagaaggaaggagttagtggctgtgtcaccccgacagagagccttgcctctctctgcaccacccagtcagagatcacagacctcagcagtgccagttgccttcgaggttttatgccagaaaaattacaaattgtcaagccccttgaaggatcacaaactctgtatcactggcagcagcttgctcaaccaaacttgggaaccatccttgatccacgaccaggtgtcattactaaaggctttacccagttgcccggggatgctatttatcacatctcagatttagaagaggatgaagaggagggtattacttttcaggttcagcaacctcttgaagtggaagagaaactttcaacatccaagccagtaacagggatcttcctgccacccattacttcagcaggtggaccagttacagttgcaaccgccaacccaggaaagtgcctgtcgtgcacaaactcaacattcactttcaccacctgtagaatattacatccctctgacatcactcaggttacccccagctctgggttcccttcattatcctgtggaagtagcggtagcagttcatccaacacggctgtgaattctcctgccttgtcctatagactcagcattggtgagtccatcaccaaccgacgagattccactacaaccttcagtagcaccatgagcttggccaaacttctacaagagcgaggcatctctgccaaagtgtaccacagcccaatttcagagaaccccctccagcctctccctaaatccctggctatcccttccacaccaccaaattcaccatctcactcaccttgcccttctcctttaccctttgagcctcgagtgcatctctctgaaaattttttggcctctcgaccagctgagacattcctccaggagatgtatggcttgagaccctcccggaaccctcctgatgttggccagttgaagatgaacttagtggacaggctgaagagactggggatagccagagtggtcaagaaccctgtgcccaagagaatggaagatgccaggaggcagaaattggtcctcaaaaaccagattctgctgtttatttaaattcaggtagcagtttattaggtggactaaggaggaatcagagtcttccagtcataatgggtagctttgctgccccagtttgcacatcctcacccaaaatgggtgtcctgaaggaggactgaggttcagcagttaactgaccttttatacaagttagcacatgaaggatagatatgcactgaaacatgtggtctggtctgacttgagagaaaaggaatgttgcacaagggttgtgaatgtgaaagggggaatggaggaatggaaataaaattgggatgagccctaatggaggaagtcgggcaaattgaaagtataaatgaatgggccatgagtgttcagagggagaaaagaaaggtttaatatactccttcagttgagttttcttgtcttgaacataaaaagtgaatacaaataaattcagtaatactaaaacatacagagatactgaacttgctggcacatttacttctggtaagcataaagcagagagaacccaggttagaaggatgggaagagaaaaggagcagttttattgcttatagaaagccgttctgaggggttggtggggtaagctcagtctattactgagacaatagtgagatggcttatatgtttcccctgttaatatctggttaaattatgtatccatcaaatggtatgctcgcagcattagcaaaattaggagtttcatctttttcattgaatcacaggtggagactcctattttcctttctgttttcaggcctttgagcccctgggagcccaaataccactcaattattttgtatttatgattaataaaagttcattttt

SEQ ID NO: 31875 - DNA, 5923 bp, Homo sapiens
ctgcaatgaaaaattacacttctattttctttcctaaagggaaaaaggaagaatgcaacaaaactgaagtatgttctgccacgttcctgaactgcagccataggagccctcccagccctacccaaaccagcctactccctctcaagagctcacagctgcaggactagagccagatgtgccccggcaataaggacttcttccatggagaagcccctcaccgtcctgcgagtgagcctgtaccatcccacgctgggcccatctgcctttgccaatgtcccaccacggctgcagcatgataccagccctctgcttctcggacgggggcaggacgcccacctccagctgcagctccctcgcctctcccgccgtcacctgtccctggagccctacctggagaaaggcagtgccctgctggccttctgcctcaaggccctgagccgcaagggctgtgtgtgggtcaatgggctgacgctgaggtacctggagcaggtccccctgagcaccgtcaacagggtctccttctcaggcatccagatgctggttcgcgtagaagaaggcacatccctggaggcttttgtctgctatttccatgtcagcccttcacccctgatttacagacctgaggctgaggaaactgacgaatgggaaggcatctcccaggggcagcctccccctggttcagggtagcagatccaggttgcctggggtttctccacggcccttcccagacttgggacagccctctccagccaagacctggaggaggaacagaaatacagctccagagggaacccccagacagtgcactctgctagccctgccactagagcaagcctttgctagatgaaacaggatttgaaatacttgagctgcatcatgcaaggttgacaagcaaaacccactggctgccttgctcataatgaaccaattctgcaaacaccgaacaaacagcccaggggggagaagcaccctctgtggccagagctatgcaatgtaatgggaacatcatatacttttagaggccctgaggggttctggggagcctctctcagcatttccacacatttctccctgttgtctgactaggagttactttatgtggttcattttgtgtgctgcttaagagcaggagtttgaggttgcaccaggaatgcgtggacacatgtaacaattacatttgtggtagcttggggttaccttcagctttcaaatacccacaggcacgcggggcttaggaaagcctgagtgtaataaactgcaagtatttcattaagctggcatacccaataggattccctgatccccagatgggccacatgcacgccacgctgtcatgcagacgtgggggtgggaaatatagacgaggtgtaagaggaaattggaaaggtgggactcacatttctggaaaggatgcaggcagggctcagggtttcctgaggatgggagctgggagctgggcctgcctggaaattcattgtcccccttatcatcctcatcctcacactccgcattctctgtcacttctggatcaaggccttggttgacttgagggcaaggtctttagggaatgaggggatggggtgggggtttgtgtaagaactcagcccagcagttatttcgctcagggtgagtcacacaccaatgggggtgggggaattccttccaaataagggactcgttaggagccaggtacgccaagggcaggaggattttctcggtgaacaagggcagcagctatttgccacgccatgctgagaaggggagagtgtggtttagaaacaacgttcactagtgtgatgcagggagggatctacatggtcaccatgatcccagaccccactctccagggaatctgaggcaccaagggcacagccctgttcccctggctgactcgaatctctgggtctgtagctgtcaacaatttctgttttctgcccaaaaggatgatcgttttgcacccagggcaagctacaaggaggtccaacttcactcacaggccctgagcatcttctccatcaggaaaacagaggtgggcaagacccaggcttgccctggtgtgggaagcttcctctccaatagggatgaagcaaaaacactcagatcacagccacaaggcagggagagcagggctgctaggaaggggctctctgatgctgtgaatgaccccttgggacccccaaagcagttcctcattcattcagcaaaccttcaccaagcacccaccttgtgccagatctgtgcaaagccacggaactgaaccagaagtgaataaggcaaactccctcagggagtttaccttgcactcaggaaagtcaagcattcaggagtgcattacttatttgatcactactatgattagtgctatagtcattgtatttttctctctcctccagctgggctcacattctcttgttaagtggccttgcctgttgagtgcctaccatgtgcttagcactctgctaggtgctgtgtgtattaactgcacttaacagataaggaaactgagacttggaaaggttacatatcttgcccaacatcacaccatcagtagctatgcgatttgggcaagtgatttagtctgctcttgcctctatttctcccgctggaaaatgggtaagataatagtactacctgctagagttacgagggtcttagaaggtgacacctgtaaagcattcaatcagtgcccagcacacacttaataagggttagctactatcatgagacctgagagaggagggctcaccatccacacggagctaaggaagactcacaccccagtaagctggctccagaacccaagggcttacctgtgctctgtgattccccaactagggatttagttgtagccacggacctggtaggcaacagggaggggattttaatctgctccttgcatcagaaggtccaataggcagggttagtataatgggagatgccctggtagggctggcaaggagaagaagccacatgtattttggtctgatgaaaagcagcagtgatctgtcactgaccaaaatggtcccccaactatgcattacggagcagcaacccacatacagaactcgagaagccacggcctggagactgtacctggacaccaaagactggagagaggagctggtggggaaaccccagagttcccagggtgccactccccagctccaccagagaactttgggaatgagctgctgcccctgagtgcccctctccagggcctcagtgagggtctctaccctccagggaggaacaaaaccttgccagctggggtcctgcgagagggggcagttcaattcctccacaggggactctgcaactccaatctttcgagtgaagcatctgcgaggccctcagggacccaggatgaactgcatagcagcagaaggaagacaggccagaccaggcgggagggagcccggaaacatctggtttgtagtttcagactctacccgttcacagttcacacagtctcaccgggaaactcacaccttgccctgtaccaagtttttaaggcagttaagctctgcccatccgagacttcatttttcttgagtagaaaatcactgaaatcatcagatccatggcacccaccttcactttctcctaacagctggaaccgtcaggctggcttcagggcctggtcttcgcacttgatatcactatccctcacctgctcagacagccagagcaggcgggtgagttcctcccaacaacctccactgcattctctcagctcccaccgcagggcagcccacgtgcctgagtgaacatgtgtgcgtgtgcacacacgcaagtatgcacagacatacactaaacacgaacatacagtgcacatgaacgctgctcccagctagggccctctggtcagactgctgcctgggttagaattcttgtccccacccccacttactatagttctgtgatcctggacaagtaactgaatctctccgtgccacagtttcttcttgtagaaaacgggaaagttcacagtacttacctccttagagtcattgtgaaggtcagtttgaggcatcacaaatttaaggcacccagacataagggtcaacagggttagctatcactgtccagtttggtgggaggaactgaatgcatgtaggcacatggacccagtctacactcaggcacaaaaggagctacattagttacattcaggcataccccagagcactacaattctctgagacattgtctggaaatctagaaatcatctccttgccctttaaggtattttaaccctcgcattcctctgcttttccaagaatgtgaatcttgccaagctgtccgtgagagacacgggctcccctcgagggagacttgcaaatgctccataaacagccacagtgtggggctctgccatgaggaagtcacagcagacacgctagacagcatagtcctggatgcaacctggaggaagggaggcccatggtggagcactcactccgtgcctgtctgcccggtgagacctcaagttccttgcagacaaaggccatgggttgttggctcttgtgttcccggtggcctttccagagctgaacagaggacagatgcacagacgggggggctctggtggtcaaggcagcagtccccttggatactaaagtctgagccaggcccctcaggcccggcatgggcagtgcgaggcccatagtggtgggaagccagttggccagctggggtgagaaggccgcgaagccatgggcagacaggaagtggaggtgaatgtctctgcctcctgtaggcctcagcagggacagcacagaccctctggctggggcagcgcagaccctctagctggggcagaacaaggctggtgcttccttctagtccttgagactttgtagctctaactcaagcagaaccctggggttttgggattctgtgtggtgactgctgaggaaggtttatggatttgacagggtgcatgtcacagagagacagttctcagtcagcacttcctgtcccctgcagaggctcataggggacagcccctgccaaggagaccctggaggggctctgaggatagcaatcagaggttgggctggctggactgagcccaggcctgttgcccaccaagtctccataggttctagtctgacccctctctccacccctgggctatgcaggccagcccgtgcagaccacccccgacgcgtccacttgcaacacccgcctcactgtgccaacactccatccacacaggaaaggactgagaacgtgatgcttaacccaaaggagtgagtttcataggatgggtggctttaacagtttcacagcaggacactgagggaatatttccctatcccttcaaatggacggtcactacagaaacgtgtagagcaagactttgtcaaggggctgtttccaggtctcccggtgtctaaatagcagagctggaatgggaactgagaaccgattctttccacaaccgcccactgagcagcaaggctgcagccagcaaagaggtgcggaggcaagcaagctccatgtggtggggacagcgcattgcgacctccaccacccctgcagtgggctgccagctgagccacctgtcttccactgtatctactgtacgaacttctccagctctgctctgttttctcttcctcagcatccaccccgtgacacgtagtggtggctgatgtcgccacagtaccatgaggttaacaggtcctccctccagcttccctcatggtggcagcctaacctgcattgcagccgttcaccggacaccgcaccagaccctcaaaacccatccaagactgtgggaggagtaaacaacccagcccagttaagaggagatgccgaatttaatgaaccctatttgaattgcagggctgtgattcctcttacctttaacgtgaactcacaggcggattaaagtgaaataaaacctaccatttga

SEQ ID NO: 31876 - DNA, 3178 bp, Homo sapiens
agtgcggggtctgacagaggaggctccgtgtctgcagctagtgtgtcaactcagcgtttctcctctcgtccctggtgaggtgtagcggcggcacgcggctggagatcccctgtggcctccagtttaggaagggtccagcatcccaagggaggggtgtgtgggcgaggggtctctgggcccggggtcgcggctgtgaggagaggatgcccgcgcggcggcatctcaggcacctggaggaggccgcgctttctcctcagggaaccggcgccttggcagcccccggcgacgccgcccccttcgcggcctaggttggtctggtgagccgggaagcgggcgtcgttcgcagcgccgctgtgaccaccgcgtcccgggcggagctgggctcagtgccggcctgggcctagagtccgagcctcgagctgccggcgtggggggtcgcgagtggcctaatgcggcctcgaagccgaaggacccgagtccgagctcgcactccgacccgctggtgctgtggaaaactcaggtggccttccgctttcgtagcctctaaagtggggaccaagactttcacctcttaggattgtagtcgggattaaaagattttcccggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttggagttc

SEQ ID NO: 31877 - DNA, 2687 bp, Homo sapiens
cgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttgga

SEQ ID NO: 31878 - DNA, 532 bp, Homo sapiens
agtgcggggtctgacagaggaggctccgtgtctgcagctagtgtgtcaactcagcgtttctcctctcgtccctgaaatgaaagagaaagttcatgtcttcctttgtggttttcaggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgt

SEQ ID NO: 31879 - DNA, 1043 bp, Homo sapiens
agaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaattgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattccta

SEQ ID NO: 31880 - DNA, 983 bp, Homo sapiens
ggaggctccgtgtctgcagctagtgtgtcaactcagcgtttctcctctcgtccctgcctctaaagtggggaccaagactttcacctcttaggattgtagtcgggattaaaagattttcccggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagg

SEQ ID NO: 31881 - DNA, 1162 bp, Homo sapiens
ggggcggggcggacgcagagccgcgtttagtctatcgctgcggttgcgagcgctgtagggagcctgtgctgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgg

SEQ ID NO: 31882 - DNA, 1202 bp, Homo sapiens
tttagtctatcgctgcggttgcgagcgctgtagggagcctgtgctgtgccgcgcagttaggcagcagcagccgcggagcagtagccgccgtgggagggagccatgaagcattacgagcagagagatgattcttcaagaaaccaaagcagcctgtggcattccagcgattcctcattgctcaagggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtc

SEQ ID NO: 31883 - DNA, 1346 bp, Homo sapiens
cccgggggcggggcttcgtccaggcgcgcagggaccagcgggcctcgccctcccgcgccgctttccgattggcagccgcccgcggggcattgtgggccgtccgcgcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttca

SEQ ID NO: 31884 - DNA, 1231 bp, Homo sapiens
tccgcgcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaagcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcc

SEQ ID NO: 31885 - DNA, 1582 bp, Homo sapiens
gaaaagaggctgaggcaacctgaaggaggagctctcattaccttctgcccatcacttaataaatagccagccaattcatcaacattctggtacactgttggagagatgagacagtcacaccagctgcccctagtggggctcttactgttttcttttattccaagccaactatgcgagatttgtgaggtaagtgaagaaaactacatccgcctaaaacctctgttgaatacaatgatccagtcaaactataacaggggaaccagcgctgtcaatgttgtgttgtccctcaaacttgttggaatccagatccaaaccctgatgcaaaagatgatccaacaaatcaaatacaatgtgaaaagcagattgtcagatgtaagctcgggagagcttgccttgattatactggctttgggagtatgtcgtaacgctgaggaaaacttaatatatgattaccacctgatcgacaagctagaaaataaattccaagcagaaattgaaaatatggaagcacacaatggcactcccctgactaactactaccagctcagcctggacgttttggccttgtgtctgttcaatgggaactactcaaccgccgaagttgtcaaccacttcactcctgaaaataaaaactattattttggtagccagttctcagtagatactggtgcaatggctgtcctggctctgacctgtgtgaagaagagtctaataaatgggcagatcaaagcagatgaaggcagtttaaagaacatcagtatttatacaaagtcactggtagaaaagattctgtctgagaaaaaagaaaatggtctcattggaaacacatttagcacaggagaagccatgcaggccctctttgtatcatcagactattataatgaaaatgactggaattgccaacaaactctgaatacagtgctcacggaaatttctcaaggagcattcagcaatccaaacgctgcagcccaggtcttacctgccctgatgggaaagaccttcttggatattaacaaagactcttcttgcgtctctgcttcaggtaacttcaacatctccgctgatgagcctataactgtgacacctcctgactcacaatcatatatctccgtcaattactctgtgagaatcaatgaaacatatttcaccaatgtcactgtgctaaatggttctgtcttcctcagtgtgatggagaaagcccagaaaatgaatgatactatatttggtttcacaatggaggagcgctcatgggggccctatatcacctgtattcagggcctatgtgccaacaataatgacagaacctactgggaacttctgagtggaggcgaaccactgagccaaggagctggtagttacgttgtccgcaatggagaaaacttggaggttcgctggagcaaatactaataagcccaaactttcctcagctgcataaaatccatttgcagtggagttccatgtttattgtccttatgccttcttcttcatttatcccagtacgagcaggagagttaataacctccccttctctctctacatgttcaataaaagttgttgaaagattaacaactatacaaaaaga

SEQ ID NO: 31886 - DNA, 2535 bp, Homo sapiens
actccttgtcctgggctaggtgggcactaccaggggctcctttggtaaggagtaccgggtaggcacccggtcctgccaatccaccactggaacagctggggggacagcagacaggcacggtcggacagacttgacagatcaggcatcaggccctctgcgctggtcccgggctctttaagcaggaacgtgaatggcctcaagatgtctcacatggtcccactagccctcctcctccctttgttccctacctccaggagggctgctctgcccttccttcctctgttctttggccttatgttccccgccaccacagaccttcccccgccccacccctctgcagacttagccgtgcattgcaggcatggaggattaatcagtgacaggaagctgcgtctctcggagcggtgaccagctgtggtcaggagagcctcagcagggccagccccaggagtctttcccgattcttgctcactgctcacccacctgctgctgccatgaggcaccttggggccttcctcttccttctgggggtcctgggggccctcactgagatgtgtgaaataccagagatggacagccatctggtagagaagttgggccagcacctcttaccttggatggaccggctttccctggagcacttgaaccccagcatctatgtgggcctacgcctctccagtctgcaggctgggaccaaggaagacctctacctgcacagcctcaagcttggttaccagcagtgcctcctagggtctgccttcagcgaggatgacggtgactgccagggcaagccttccatgggccagctggccctctacctgctcgctctcagagccaactgtgagtttgtcaggggccacaagggggacaggctggtctcacagctcaaatggttcctggaggatgagaagagagccattgggcatgatcacaagggccacccccacactagctactaccagtatggcctgggcattctggccctgtgtctccaccagaagcgggtccatgacagcgtggtggacaaacttctgtatgctgtggaacctttccaccagggccaccattctgtggacacagcagccatggcaggcttggcattcacctgtctgaagcgctcaaacttcaaccctggtcggagacaacggatcaccatggccatcagaacagtgcgagaggagatcttgaaggcccagacccccgagggccactttgggaatgtctacagcaccccattggcattacagttcctcatgacttcccccatgcgtggggcagaactgggaacagcatgtctcaaggcgagggttgctttgctggccagtctgcaggatggagccttccagaatgctctcatgatttcccagctgctgcccgttctgaaccacaagacctacattgatctgatcttcccagactgtctggcaccacgagtcatgttggaaccagctgctgagaccattcctcagacccaagagatcatcagtgtcacgctgcaggtgcttagtctcttgccgccgtacagacagtccatctctgttctggccgggtccaccgtggaagatgtcctgaagaaggcccatgagttaggaggattcacatatgaaacacaggcctccttgtcaggcccctacttaacctccgtgatggggaaagcggccggagaaagggagttctggcagcttctccgagaccccaacaccccactgttgcaaggtattgctgactacagacccaaggatggagaaaccattgagctgaggctggttagctggtagcccctgagctccctcatcccagcagcctcgcacactccctaggcttctaccctccctcctgatgtccctggaacaggaactcgcctgaccctgctgccacctcctgtgcactttgagcaatgccccctgggatcaccccagccacaagcccttcgagggccctataccatggcccaccttggagcagagagccaagcatcttccctgggaagtctttctggccaagtctggccagcctggccctgcaggtctcccatgaaggccaccccatggtctgatgggcatgaagcatctcagactccttggcaaaaaacggagtccgcaggccgcaggtgttgtgaagaccactcgttctgtggttggggtcctgcaagaaggcctcctcagcccgggggctatggccctgaccccagctctccactctgctgttagagtggcagctccgagctggttgtggcacagtagctggggagacctcagcagggctgctcagtgcctgcctctgacaaaattaaagcattgatggcctgtggacctgctacagtggcctggtgcctcatactcctcaggtgcaggggcagggacaagagaagggggaagtaaccccatcagggaggagtggagggtgcctgagccgccatgtgggcattgggggagtgatgggaatgccagcagtgatgacattgactactgactgagcacccactactatgactgagcactcactcgctagatactatcttgaactgctctgtga

SEQ ID NO: 31887 - DNA, 1870 bp, Homo sapiens
ggattaatcagtgacaggaagctgcgtctctcggagcggtgaccagctgtggtcaggagagcctcagcagggccagccccaggagtctttcccgattcttgctcactgctcacccacctgctgctgccatgaggcaccttggggccttcctcttccttctgggggtcctgggggccctcactgagatgtgtgaaataccagagatggacagccatctggtagagaagttgggccagcacctcttaccttggatggaccggctttccctggagcacttgaaccccagcatctatgtgggcctacgcctctccagtctgcaggctgggaccaaggaagacctctacctgcacagcctcaagcttggttaccagcagtgcctcctagggtctgccttcagcgaggatgacggtgactgccagggcaagccttccatgggccagctggccctctacctgctcgctctcagagccaactggcatgatcacaagggccacccccacactagctactaccagtatggcctgggcattctggccctgtgtctccaccagaagcgggtccatgacagcgtggtggacaaacttctgtatgctgtggaacctttccaccagggccaccattctgtggacacagcagccatggcaggcttggcattcacctgtctgaagcgctcaaacttcaaccctggtcggagacaacggatcaccatggccatcagaacagtgcgagaggagatcttgaaggcccagacccccgagggccactttgggaatgtctacagcaccccattggcattacagttcctcatgacttcccccatgcgtggggcagaactgggaacagcatgtctcaaggcgagggttgctttgctggccagtctgcaggatggagccttccagaatgctctcatgatttcccagctgctgcccgttctgaaccacaagacctacattgatctgatcttcccagactgtctggcaccacgagtcatgttggaaccagctgctgagaccattcctcagacccaagagatcatcagtgtcacgctgcaggtgcttagtctcttgccgccgtacagacagtccatctctgttctggccgggtccaccgtggaagatgtcctgaagaaggcccatgagttaggaggattcacatatgaaacacaggcctccttgtcaggcccctacttaacctccgtgatggggaaagcggccggagaaagggagttctggcagcttctccgagaccccaacaccccactgttgcaaggtattgctgactacagacccaaggatggagaaaccattgagctgaggctggttagctggtagcccctgagctccctcatcccagcagcctcgcacactccctaggcttctaccctccctcctgatgtccctggaacaggaactcgcctgaccctgctgccacctcctgtgcactttgagcaatgccccctgggatcaccccagccacaagcccttcgagggccctataccatggcccaccttggagcagagagccaagcatcttccctgggaagtctttctggccaagtctggccagcctggccctgcaggtctcccatgaaggccaccccatggtctgatgggcatgaagcatctcagactccttggcaaaaaacggagtccgcaggccgcaggtgttgtgaagaccactcgttctgtggttggggtcctgcaagaaggcctcctcagcccgggggctatggccctgaccccagctctccactctgctgttagagtggcagctccgagctggttgtggcacagtagctggggagacctcagcagggctgctcagtgcctgcctctgacaaaattaaagcattgatggcctgtggacctgc

SEQ ID NO: 31888 - DNA, 2718 bp, Homo sapiens
agccggaagccacgcctgcccactagcccgacgcccgcctggcgggaacatgggctcgcccctcaccagcgatctgcagtcagttggtagcgcctgcacgtcgcgcgcggtgttcgattgtcgctgcctggggaggaggagccggagccgccgccgccgccgccgccgccgcgggcttcgttcgtaaggaagggggcctaggcccgggcctgcggtggtgggggttgctgcgcgccgggggtcgctcctgctgtgtcttccgctccagcttcgcccacttccccttgccagcggggtgggcgcggagaagacctgccggagccatggaggacgaagtggtccgctttgccaagaagatggacaagatggtgcagaagaagaacgcgtccacaagaatcggaatgtcagttaatgctattcgcaagcagagtacagatgaggaagttacatctttggcaaagtctctcatcaaatcctggaaaaaattattagatgggccatcaactgagaaagaccttgacgaaaagaagaaagaacctgcaattacatcgcagaacagccctgaggcaagagaagaaagtacttccagcggcaatgtaagcaacagaaaggatgagacaaatgctcgagatacttatgtttcatcctttcctcgggcaccaagcacttctgattctgtgcggttgaagtgtagggagatgcttgctgcagctcttcgaacaggggatgactacattgcaattggagctgatgaggaagaattaggatctcaaattgaagaagctatatatcaagaaataaggaatacagacatgaaatacaaaaatagagtacgaagtaggatatcaaatcttaaagatgcaaaaaatccaaatttaaggaaaaatgtcctctgtgggaatattcctcctgacttatttgctagaatgacagcagaggaaatggctagtgatgagctgaaagagatgcggaaaaacttgaccaaagaagccatcagagagcatcagatggccaagactggtgggacccagactgacttgttcacatgtggcaaatgtaaaaagaagaattgcacttacacacaggtacaaacccgtagtgctgatgaaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacatatatc

SEQ ID NO: 31889 - DNA, 2858 bp, Homo sapiens
agggggccgaaaacccgccccgtgagggggcgggaccggaggtgaacgcgcagcaaaaccgggcgccttccacgaccctctagccggaagccacgcctgcccactagcccgacgcccgcctggcgggaacatgggctcgcccctcaccagcgatctgcagtcagttggtagcgcctgcacgtcgcgcgcggtgttcgattgtcgctgcctggggaggaggagccggagccgccgccgccgccgccgccgccgcgggcttcgttcgtaaggaagggggcctaggcccgggcctgcggtggtgggggttgctgcgcgccgggggtcgctcctgctgtgtcttccgctccagcttcgcccacttccccttgccagcggggtgggcgcggagaagacctgccggagccatggaggacgaagtggtccgctttgccaagaagatggacaagatggtgcagaagaagaacgcggctggagcattggatttgctaaaggagcttaagaatattcctatgaccctggaattactgcagtccacaagaatcggaatgtcagttaatgctattcgcaagcagagtacagatgaggaagttacatctttggcaaagtctctcatcaaatcctggaaaaaattattagatgggccatcaactgagaaagaccttgacgaaaagaagaaagaacctgcaattacatcgcagaacagccctgaggcaagagaagaaagtacttccagcggcaatgtaagcaacagaaaggatgagacaaatgctcgagatacttatgtttcatcctttcctcgggcaccaagcacttctgattctgtgcggttgaagtgtagggagatgcttgctgcagctcttcgaacaggggatgactacattgcaattggagctgatgaggaagaattaggatctcaaattgaagaagctatatatcaagaaataaggaatacagacatgaaatacaaaaatagagtacgaagtaggatatcaaatcttaaagatgcaaaaaatccaaatttaaggaaaaatgtcctctgtgggaatattcctcctgacttatttgctagaatgacagcagaggaaatggctagtgatgagctgaaagagatgcggaaaaacttgaccaaagaagccatcagagagcatcagatggccaagactggtgggacccagactgacttgttcacatgtggcaaatgtaaaaagaagaattgcacttacacacaggtacaaacccgtagtgctgatgaaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacata

SEQ ID NO: 31890 - DNA, 1432 bp, Homo sapiens
gttcgtaaggaagggggcctaggcccgggcctgcggtggtgggggttgctgcgcgccgggggtcgctcctgctgtgtcttccgctccagcttcgcccacttccccttgccagcggggtgggcgcggagaagacctgccggagccatggaggacgaagtggtccgctttgccaagaagatggacaagatggtgcagaagaagaacgcggctggagcattggatttgctaaaggagcttaagaatattcctatgaccctggaattactgcaggaaatggctagtgatgagctgaaagagatgcggaaaaacttgaccaaagaagccatcagagagcatcagatggccaagactggtgggacccagactgacttgttcacatgtggcaaatgtaaaaagaagaattgcacttacacacaggtacaaacccgtagtgctgatgaaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggat

SEQ ID NO: 31891 - DNA, 1164 bp, Homo sapiens
ctttggtcgagagggaaagcagaagaagtctgctggtcacagcggggcacctcgaggagaggacgactaggagcacacggcccggaaaggtccagaataactgtgcttgaagaagaaaattcccaacatggacaaaccacgcaaagaaaatgaagaagagccgcagagcgcgcccaagaccgatgaggagaggcctccggtggagcactctcccgaaaagcagtcccccgaggagcagtcttcggaggagcagtcctcggaggaggagttctttcctgaggagctcttgcctgagctcctgcctgagatgctcctctcggaggagcgccctccgcaggagggtctttccaggaaggacctgtttgaggggcgccctcccatggagcagcctccttgtggagtaggaaaacataagcttgaagaaggaagctttaaagaaaggttggctcgttctcgcccgcaatttagaggggacatacatggcagaaatttaagcaatgaggagatgatacaggcagcagatgagctagaagagatgaaaagagtaagaaacaaactgatgataatgcactggaaggcaaaacggagccgtccttatcctatttaatgtgttcggcctttaattctgttttgcctgctaatagtattgccattgccacctggactttctgtttgcattttcttaatgccttttcccatattctgaattttaactttttgtgaggctttattttagatgtttagcatgtaactcgcttaaagttgaggtttccccctaaaatctacaagtttccctctttcagtcatgagccctacacatttgcatgaaagatgtacattatatattgtgaaacgaaaaaagcaattttcaaatggtatatattgtatcccatttttgtaaaaaaaatgtatatttatatattaatatgcaaagaaaaagctaaaagtatagacttcaaaggcataacagtggttgtgtggtaagataataggtgattttttaaatttttgttttatctgaatttctcattttttcaggacaaacgttttacttgtgttgcaaaaatatataatgaaaaaatcacacaattttgaagaaaactgtcaatcagcttataacgacaatgtggcacttaataaatacttgtcagaactttaaaaaaa

SEQ ID NO: 31892 - DNA, 1201 bp, Homo sapiens
gcctgtccaccatctccctattaccctttggtcgagagggaaagcagaagaagtctgctggtcacagcggggcacctcgaggagaggacgactaggagcacacggcccggaaaggtccaggtcagggaagggaataactgtgcttgaagaagaaaattcccaacatggacaaaccacgcaaagaaaatgaagaagagccgcagagcgcgcccaagaccgatgaggagaggcctccggtggagcactctcccgaaaagcagtcccccgaggagcagtcttcggaggagcagtcctcggaggaggagttctttcctgaggagctcttgcctgagctcctgcctgagatgctcctctcggaggagcgccctccgcaggagggtctttccaggaaggacctgtttgaggggcgccctcccatggagcagcctccttgtggagtaggaaaacataagcttgaagaaggaagctttaaagaaaggttggctcgttctcgcccgcaatttagaggggacatacatggcagaaatttaagcaatgaggagatgatacaggcagcagatgagctagaagagatgaaaagagtaagaaacaaactgatgataatgcactggaaggcaaaacggagccgtccttatcctatttaatgtgttcggcctttaattctgttttgcctgctaatagtattgccattgccacctggactttctgtttgcattttcttaatgccttttcccatattctgaattttaactttttgtgaggctttattttagatgtttagcatgtaactcgcttaaagttgaggtttccccctaaaatctacaagtttccctctttcagtcatgagccctacacatttgcatgaaagatgtacattatatattgtgaaacgaaaaaagcaattttcaaatggtatatattgtatcccatttttgtaaaaaaaatgtatatttatatattaatatgcaaagaaaaagctaaaagtatagacttcaaaggcataacagtggttgtgtggtaagataataggtgattttttaaatttttgttttatctgaatttctcattttttcaggacaaacgttttacttgtgttgcaaaaatatataatgaaaaaatcacacaattttgaagaaaactgtcaatcagcttataacgacaatgtggcacttaataaatacttgtcagaactttaaaaaaa

SEQ ID NO: 31893 - DNA, 721 bp, Homo sapiens
aggggaagtagcacagaggaagaggcaatactacccgagactagatgcggaccgtctctggcaaccaggaaaaggcaaatacaaagagaggtctgctggtcacagcggggcacctcgaggagaggacgactaggagcacacggcccggaaaggtccagaataactgtgcttgaagaagaaaattcccaacatggacaaaccacgcaaagaaaatgaagaagagccgcagagcgcgcccaagaccgatgaggagaggcctccggtggagcactctcccgaaaagcagtcccccgaggagcagtcttcggaggagcagtcctcggaggaggagttctttcctgaggagctcttgcctgagctcctgcctgagatgctcctctcggaggagcgccctccgcaggagggtctttccaggaaggacctgtttgaggggcgccctcccatggagcagcctccttgtggagtaggaaaacataagcttgaagaaggaagctttaaagaaaggttggctcgttctcgcccgcaatttagaggggacatacatggcagaaatttaagcaatgaggagatgatacaggcagcagatgagctagaagagatgaaaagagtaagaaacaaactgatgataatgcactggaaggcaaaacggagccgtccttatcctatttaatgtgttcggcctttaattctgttttgcctgctaatagtattgccattgcca

SEQ ID NO: 31894 - DNA, 1195 bp, Homo sapiens
tcttttttttgcctgtccaccatctccctattaccctttggtcgagagggaaagcagaagaagtctgctggtcacagcggggcacctcgaggagaggacgactaggagcacacggcccggaaaggtccaggtcagggaagggaataactgtgcttgaagaagaaaattcccaacatggacaaaccacgcaaagaaaatgaagaagagccgcagcgcccaagaccgatgaggagaggcctccggtggagcactctcccgaaaagcagtcccccgaggagcagtcttcggaggagcagtcctcggaggaggagttctttcctgaggagctcttgcctgagctcctgcctgagatgctcctctcggaggagcccgcaggagggtctttccaggaaggacctgtttgaggggcgccctcccatggagcagcctccttgtggagtaggaaaacataagcttgaagaaggaagctttaaagaaaggttggctcgttctcgcccgcaatttagaggggacatacatggcagaaatttaagcaatgaggagatgatacaggcagcagatgagctagaagagatgaaaagagtaagaaacaaactgatgataatgcactggaaggcaaaacggagccgtccttatcctatttaatgtgttcggcctttaattctgttttgcctgctaatagtattgccattgccacctggactttctgtttgcattttcttaatgccttttcccatattctgaattttaactttttgtgaggctttattttagatgtttagcatgtaactcgcttaaagttgaggtttccccctaaaatctacaagtttccctctttcagtcatgagccctacacatttgcatgaaagatgtacattatatattgtgaaacgaaaaaagcaattttcaaatggtatatattgtatcccatttttgtaaaaaaaatgtatatttatatattaatatgcaaagaaaaagctaaaagtatagacttcaaaggcataacagtggttgtgtggtaagataataggtgattttttaaatttttgttttatctgaatttctcattttttcaggacaaacgttttacttgtgttgcaaaaatatataatgaaaaaatcacacaattttgaagaaaactgtcaatcagcttataacgacaatgtggcacttaataaatacttgtcagaacttt

SEQ ID NO: 31895 - DNA, 1177 bp, Homo sapiens
gtgaaccgaagtccttatattcccgggcttctttctcctctgggtaccagctccttactgccctgcagacaagcgtgccgtgcgtgcttgtggccaagggaaggaagagctggttgatccacagatagctccttcctccccgccccttcctttttgtttggaggtcccaggatctgtgttcacagacatctgggggaagaaaaggagcaggaaactaccccgcacagagttaagcaggaaacaacaacaacatcatgcaaaaaccctgcaaagaaaacgaaggaaagccaaagtgcagcgtgccaaagagggaggaaaaacgcccgtatggagaatttgaacgccagcaaacagaagggaattttagacagaggctgcttcagtctctcgaagaatttaaagaggacatagactataggcattttaaagatgaagaaatgacaagggagggagatgagatggaaaggtgtttggaagagataaggggtctgagaaagaaatttagggctctgcattctaaccataggcattctcgggaccgtccttatcccatttaattaatttctctgacaattcaattattttctgttattaatgttgccactgctttctgtttgtctgcactttcttgataaatatttgctatcgttttactccagtcattcgatgttgctgagatttacatatgactcttgtcaacatctcatcttttgacccaatcttattcatttaataagaggtctcattcatttgcatggaaaaatgctcattgtatattgcaaagtgaaaataacgagttgcaaaacagtgtatacatatatgtgtgtatatatgtacactttatttgtacatttctatgtgacataatgcaaaggaaagtgtctgattttattatacaccaaaggttaacagtgaatctctgtgtgatctctttttttttctttttgcctatctgcatcttctcacttgccaaaaaatgaatatatgtttatgtgtgtatattacttgtgtcacaaaaaaccctaaagtagacagtaaaagaacttgtcaatcgcctttggaaggcaatgaaacacttaataaactctcaataacagaagcgtaaaaatgaaatgtaaacctccaattacctctggatctcttagccagagtaataaactggtaattattacagata

SEQ ID NO: 31896 - DNA, 852 bp, Homo sapiens
tctcctctgggtaccagctccttactgccctgcagacaagcgtgccgtgcgtgcttgtggccaagggaaggaagaggtcccaggatctgtgttcacagacatctgggggaagaaaaggagcaggaaactaccccgcacagagttaagcaggaaacaacaacaacatcatgcaaaaaccctgcaaagaaaacgaaggaaagccaaagtgcagcgtgccaaagagggaggaaaaacgcccgtatggagaatttgaacgccagcaaacagaagggaattttagacagaggctgcttcagtctctcgaagaatttaaagaggacatagactataggcattttaaagatgaagaaatgacaagggagggagatgagatggaaaggtgtttggaagagataaggggtctgagaaagaaatttagggctctgcattctaaccataggcattctcgggaccgtccttatcccatttaattaatttctctgacaattcaattattttctgttattaatgttgccactgctttctgtttgtctgcactttcttgataaatatttgctatcgttttactccagtcattcgatgttgctgagatttacatatgactcttgtcaacatctcatcttttgacccaatcttattcatttaataagaggtctcattcatttgcatggaaaaatgctcattgtatattgcaaagtgaaaataacgagttgcaaaacagtgtatacatatatgtgtgtatatatgtacactttatttgtacatttctatgtgacataatgcaaaggaaagtgtctgattttattatacaccaaaggttaacagtgaatctctgtgtgatctctttttttt

SEQ ID NO: 31897 - DNA, 1451 bp, Homo sapiens
accggagcaggcagctgggggtgggggggcggccctgggataggggctgtggcagtacgcggggacccggctgcggtggctgcgggactgacgaatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtggttttttagaaacctaatcttatagccgccattagcattactagagttatgcaaataattgcattataaacatgtttataacttagccaaaacattgatttttataactctccaagtatgagttgaaatttcttatgtcttttgataaactgcagtattctttaagtgtactttgtccttttgtttattgctacaatttaagaactttatttaaaaacaattttggaaggttactaggtacagcttttgcagaagaaactgaactgtagccagatggtcagcaagtaaactacatgacttagagttcttgtgcattatacattttgggtaattcaaagtactgtatttgcattgactataaagcgtcgtttgcaatatttattcttccttcatagtcccttgttgtgattatacttccagttgtttaaatgtattttaaaagactcactattaactttattcagatcttaaaagctacacctttttgaactattccagtctttctccatccaattagaatgttatggaataacatgtgaagagatacagtgaaaatcatattataatgcattgaagatatcctacatgaattatcttctattaaaatatgtcccaataaatatacccataatcagtgggtcttctactgaaatcaa

SEQ ID NO: 31898 - DNA, 683 bp, Homo sapiens
acccggctgcggtggctgcgggactgacgagtgagtctcgggctggggcggaaacggagctccgggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaa

SEQ ID NO: 31899 - DNA, 1943 bp, Homo sapiens
cagacggaagtgagcgacacactctgcgtcctcgcctcaccaggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtggttttttagaaacctaatcttatagccgccattagcattactagagttatgcaaataattgcattataaacatgtttataacttagccaaaacattgatttttataactctccaagtatgagttgaaatttcttatgtcttttgataaactgcagtattctttaagtgtactttgtccttttgtttattgctacaatttaagaactttatttaaaaacaattttggaaggttactaggtacagcttttgcagaagaaactgaactgtagccagatggtcagcaagtaaactacatgacttagagttcttgtgcattatacattttgggtaattcaaagtactgtatttgcattgactataaagcgtcgtttgcaatatttattcttccttcatagtcccttgttgtgattatacttccagttgtttaaatgtattttaaaagactcactattaactttattcagatcttaaaagctacacctttttgaactattccagtctttctccatccaattagaatgttatggaataacatgtgaagagatacagtgaaaatcatattataatgcattgaagatatcctacatgaattatcttctattaaaatatgtcccaataaatatacccataatcagtgggtcttctactgaaatcaagctcattcagcttttctattaagcagccaaaaaattttttgaaaaaatatgacagcatcattccttatgcatggggaaagaagcactggagatgggtttagtattgtctttatctcagaggtggaacaaagttgtcattatagggtctataaacttaagtctccagcttatttgagactggcttaatatggctgagcccggtggctcatgcctgtaatcccagcactttcagaggacgaggcgggtagatcacttgaggccaggagtttgagaccagcctggccaccatggcaaaaccccatctctaccaaaaatgcaaaaattagctaggccatggtggcacacgcctgtaatcccagctacttgtgaggctgaggcatgagaatcgcttgaacctgggaggtggaggtggcagtgagccgagatcgcaccactgcactccagcctgggtgacagagcgagactgtctcaaaaaaaaaaaaaaaaaaa

SEQ ID NO: 31900 - DNA, 814 bp, Homo sapiens
tagcagtttacatgtggatttattcattctggagatacaatggcaaggaaacagctgtggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtg

SEQ ID NO: 31901 - DNA, 1573 bp, Homo sapiens
caggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgagaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtggttttttagaaacctaatcttatagccgccattagcattactagagttatgcaaataattgcattataaacatgtttataacttagccaaaacattgatttttataactctccaagtatgagttgaaatttcttatgtcttttgataaactgcagtattctttaagtgtactttgtccttttgtttattgctacaatttaagaactttatttaaaaacaattttggaaggttactaggtacagcttttgcagaagaaactgaactgtagccagatggtcagcaagtaaactacatgacttagagttcttgtgcattatacattttgggtaattcaaagtactgtatttgcattgactataaagcgtcgtttgcaatatttattcttccttcatagtcccttgttgtgattatacttccagttgtttaaatgtattttaaaagactcactattaactttattcagatcttaaaagctacacctttttgaactattccagtctttctccatccaattagaatgttatggaataacatgtgaagagatacagtgaaaatcatattataatgcattgaagatatcctacatgaattatcttctattaaaatatgtcccaataaatatacccataatcagtgggtcttctac

SEQ ID NO: 31902 - DNA, 816 bp, Homo sapiens
cgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgagatcatcagggaaggaagacctctctgaggagttgatgttttacctggagacctaaatgatgaggatttaaaagcttttcggacaacagcaattacaaatgcaaagaccttgaggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaa

SEQ ID NO: 31903 - DNA, 719 bp, Homo sapiens
gggagaagagggcggcgggacctttcctggcgccgctcgcagtttacatgtggatttattcattctggagatacaatggcaaggaaacagctgtgagtcttgctgtgtggcccaggctggagtgcccggctggtctcaaattcctgacctcaagtgatctccctcccaaagtgttgcgattgcaggtgtgagccactgcacctggctgctgagaaatctttgcctacagtgagggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgc

SEQ ID NO: 31904 - DNA, 5154 bp, Homo sapiens
attccgtcttgaagtagaccctggagaggtcttccaggcttgggctcagcacgcgagcacagggagcgggggtgccggcggcggaggcgcgtacggcccgagcagcccccagcccccagcgcgcacacttgggccaggggcgcgaggagtgcgcggccgccgggtgggcgctggggagcgggccctgggggcggagcctgcagcccaccgccccccacacaccccagccgaggcccggaaggggccaggcgcgcttccgtctccgccggggatgcacggagggcggagctgcggcccgaggacgcgacgcgagcccagttccggcgaggaggccgcgccagtgacagcgatggcggcggagtcggcgctccaagttgtggagaagctgcaggcgcgcctggccgcgaacccggaccctaagaagctattgaaatatttgaagaaactctccaccctgcctattacagtagacattcttgcggagactggggttgggaaaacagtaaatagcttgcgaaaacacgagcatgttggaagctttgccagggacctagtggcccagtggaagaagctggttcctgtggaacgaaatgctgagcctgatgaacaggactttgagaagagcaattcccgaaagcgccctcgggatgccctgcagaaggaggaggagatggagggggactaccaagaaacctggaaagccacggggagccgatcctatagccctgaccacaggcagaagaaacataggaaactctcggagctcgagagacctcacaaagtgtctcacggtcatgagaggagagatgagagaaagaggtgtcacagaatgtcaccaacttactcttcagaccctgagtcttctgattatggccatgttcaatcccctccatcttgtaccagtcctcatcagatgtacgtcgaccactacagatccctggaggaggaccaggagcccattgtttcacaccagaagcctgggaaaggccacagcaatgcctttcaggacagactcggggccagccaagaacgacacctgggtgaaccccatgggaaaggggttgtgagtcaaaacaaggagcacaaatcttcccacaaggacaaacgccccgtggatgccaagagtgatgagaaggcctctgtggtgagcagagagaaatcacacaaggccctctccaaagaggagaaccgaaggccaccctcaggggacaatgcaagggagaaaccgccctctagtggcgtaaagaaagagaaggacagagagggcagcagcctgaagaagaagtgtttgcctccctcagaggccgcttcagacaaccacctgaaaaagccaaagcacagagacccagagaaagccaaattggacaaaagcaagcaaggtctggacagctttgacacaggaaaaggagcaggagacctgttgcccaaggtaaaagagaagggttctaacaacctaaagactccagaagggaaagtcaaaactaatttggatagaaagtcactgggctccctccctaaagttgaggagacagatatggaggatgaattcgagcagccaaccatgtcttttgaatcctacctcagctatgaccagccccggaagaaaaagaaaaagattgtgaaaacttcagccacggcacttggagataaaggacttaaaaaaaatgactctaaaagcactggtaaaaacttggactcagttcagaaattacccaaggtgaacaaaaccaagtcagagaagccggctggagctgatttagccaagctgagaaaggtgcctgatgtgttgccagtgttgccagacctcccgttacccgcgatacaggccaattaccgtccactgccttccctcgagctgatatcctccttccagccaaagcgaaaagcgttctcttcaccccaggaagaagaagaagctggatttactgggcgcagaatgaattccaagatgcaggtgtattctggttccaagtgtgcctatctccctaaaatgatgaccttgcaccagcaatgcatccgagtacttaaaaacaacatcgattcaatctttgaagtgggaggagtcccatactctgttcttgaacccgttttggagaggtgtacacctgatcagctgtatcgcatagaggaatacaatcatgtattaattgaagaaacagatcaattatggaaagttcattgtcaccgagactttaaggaagaaagacccgaagagtatgagtcgtggcgagagatgtacctgcggcttcaggacgcccgagagcagcggctacgagtactaacaaagaatatccagttcgcacatgccaataagcccaaaggccgacaagcaaagatggcctttgtcaactctgtggccaagccacctcgtgacgtccggaggaggcaggaaaagtttggaacgggaggagcagctgtccctgagaaaatcaagatcaagccagccccgtaccccatgggaagcagccatgcttccgccagtagcatcagctttaaccccagccctgaggagccggcctatgatggcccaagcaccagcagtgcccacttggcaccagtggtcagcagcactgtttcctatgatcctaggaaacccactgtgaagaaaattgccccaatgatggccaagacaattaaagctttcaagaacagattctcccgacgataaactgaggacttgccttggaaatggaatctggggaggcaggaatacaaggacagtgggggttggggaatggaattctacaggagactggagtcttgctttgtggatccttttggtctccgagtcctgcagtctgcaggtgctgcccctgggaacctgcgtgccacagccccgcctccctgcctggagcacactttagaattctgaagatgtgaagcctctgtctcactgaggattttaaaggtcaattatacttttgttgttcattagcatctttgtaaactataagacgtagttttaattaataaatattgcccccagattgtatttatattatcccccaggtttgtttttgttttttgtcctctaccacacatttagccttttatcttccaggtccttattaaaatcagatgaaagcctagtgaaagccagtctcctgccccagctcagctctgtgtggactctggtccagacagaggactgggcatctccagagcctgcacagtacctgctgcacgtagggcaaggaatgagcactagaccgcctgtccccaagggagcctcagtggggcgacagggtgctcggcggactccacctcaggccctccccactgttgctgtgcattcctgtgcaggtgcatctctttcttactaactggtatttattaagggaggtgctctgtaggtctggagcctttccctcatcctttttgcgagtccccacctttttgtttttttttttttctttgaggctcactagaggacgcagaaccttgggagattgatttgcacagaactccccacctcccacttttacaatttccagtttctgattgaaaattttagggtttctccccactgcccttccctatctttccttcccctcaacaccatgaaggaaaaacacacacggcagggctttttgtagccctgaaggcaactttagacatttaaaatccagcactttaatctcttgttctctgtgaatcactatgagaagtgaatggttttaaaggctgtaatgctatgttggaaattggtttgttttgccttttattgaaaaggtaagatcatgtgattggaagaacacaactgttggcttgggaagaggactttgctgctgaagtgttttctaccttctgagtgtgtttaaggcaggatttggagggaaggaccagcttagggagagtgtctgagccacagcgtcaggatgggggaaaccacatgggatccatcaagttccagttgaacaggagcaagatcagaacttaggagggcagtgtcagctcccttgttggctgtcaaggaacaccgatctagtagaaacccacttggttgtgacccaggtagaggtagatgccatacatttgagatatgcgtccttaaggaacctgacaagcagactgaagggatggtaagtgtgacagcctgataagttttctcaaagcccaggatacagagccagtgttttctgtaactggagacctcagttaggccaacttcgaattccagagcaacgtaggaagtctattcagcagaaactcgacattgttcagtgtgtattgctgtgcagggtgcctattgtgacaggacacaaatgttactatgttttaatttgctatatttttgaatgggtaaagcattactttacttctcttggttacttgtaccaccattccacccctatccctagcctgccccacaaatctaatattaggaagcctcttaactgaaaccaaatgaacatttgggtcaggtgccagatgtctgctgcctagaatagctttttctaggtgtctaccaccttgaatttatctcttaactgtgtgttcaagtctttgtcattgaaactagtttttcatatcttagattcagttgtgtatgatttaatgtcccttattaggagtctttaggcagggagggaagaaaaaacagatttgttcatagcaatgtcagtatccattttggcacataaagatttttgatgagccctgtttgcatagagccagatgttttcccctcccccaagagtatctacatcagggatgtgacttggtgcgaagagtcaggggaaagaggaaaaacccaatttctaaatgacctccttgcccagcttactaaaatggctgcagagcagacacaggatgaatttgaacctgacacaggatgaatttgaacctttggtctcatttatggaaaaacttgtgcaattttttttctgtgctacactacatacaaatcaccaaattacaaattacccttttgtgatccttggtgtactgagcagtttctttggggctttttctttctgggaagcgggagggaaaggagcaaggtgtcatcctgctcttcatttgtattttggtcccaaaatgtaaatacaattttctatgttacttttttgtggtaactaccgagatgaatattttaattagataagttatatgaaaaggaaaattccatgtctaaataaaaaacaaactcca

SEQ ID NO: 31905 - DNA, 4654 bp, Homo sapiens
acgtcgggtcggcgggtggatgaacgcggccctctgtaatggcggagcgtggcggggacgggggcgagagtgaacgattcaacccgggggagctcaggatggcccaacagcaggccttgaggttccgaggtccggctcccccaccaaatgcagtgatgcgaggcccaccacctctgatgcgacctcctccaccttttggtatgatgcgaggccctcctccaccaccacggccgccctttggacgtcctccttttgatcctaatatgccgccaatgcctcctccaggagggatacctccacctatgggccctccacacctccagagaccacctttcatgcctcctcccatgagttccatgcctcctcctccgggtatgatgtttccaccaggaatgcctcctgtgactgctcctggtactccagcactacctcctacggaggagatatgggttgaaaataaaactccagatgggaaggtttattattataatgctcggacacgtgaatctgcatggaccaagccagatggagttaaggttattcagcaatcagaactgacacctatgcttgcagcccaggcacaggttcaggctcaggcccaggcgcaggctcaggcccaggcgcaggctcaggcccaggcacaagctcaggcccaggctcaggctcaggcccaggcccaggcccaggcccaggcccaggcccaagcccaagcccaggcccaggctcaggctcaggcacaagctcaggcccaggcccaggctcaggtccaggcccaggtccaggcacaagtgcaagcacaagcagttggagcttccacccctacgaccagtagcccagcacctgcagtatccacttcaacatcatcatccaccccttcctctaccacttctaccacaacaactgctacttcagttgcgcagacagtatcaacacccacaacacaagatcagaccccaagttctgctgtttcagttgccacgcctacagttagtgtttcaactcctgctcctacagccacacctgtgcaaaccgttccccagccgcaccctcagacgttacctcctgctgttcctcattcagtacctcagccaacaacagcaatacctgcttttccaccagtaatggtacctccgtttcgtgttccccttcctggcatgccaattccacttccaggtgtagcaatgatgcaaatagtcagctgcccgtatgtaaagacagtcgctaccaccaagaccggtgtattgccaggaatggcccctcctatcgtacccatgatacatccccaggttgctattgcagcttcacctgctaccttagctggagcaacagcagtttctgaatggactgaatataaaacagcagatgggaagacatattattataataatagaacattagaatcaacctgggaaaaaccccaagaactaaaggaaaaagaaaagttagaagagaagattaaagagccaattaaagaaccctctgaagagcctctgccaatggagacggaggaggaggatcctaaagaagagcctataaaggagataaaggaggagcccaaagaagaggagatgactgaagaagaaaaggctgcccagaaggcaaagccagttgctactgctcctattcctggtactccatggtgtgtcgtttggactggtgatgagcgggtcttcttttataatcccaccactcgtctttctatgtgggaccgacctgatgatctgattggcagggcagatgttgacaaaattattcaggagccccctcataaaaaaggaatggaggaattgaagaaactaaggcacccaactccgacaatgctgtcgatccaaaagtggcaattctctatgagtgcaattaaagaggaacaagaattaatggaagaaattaatgaagatgagcctgttaaagcaaaaaaacggaagagagacgataataaagacattgactcagagaaagaagctgccatggaagctgaaattaaagctgcccgagaaagggccattgtccctctggaggctcgaatgaagcagttcaaggacatgctgctagagagaggggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagatccaaaaaattaatccaagaatcagatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttatatatctgtattgtatatgattattgttacttaatttttaagagcttattttaacctgtttttaaaagcagcaaatagaatttcccacaaagtaagttgactctaaatcttaagtattacctagtttttaaaggtttgaatataataatgcagtatttgcagtataaaaaggaaggaatttgtagagaatcattttggtgctcaagtctcttagcagtgccttattgcctcatagcaagaagatgctggggttttttttgtttttgtcctttgtattaatgtatgatggtttgcgcctttttggcattctttcaacatgtcgtgtacatcacaccatgaatcagttcctaattgatatatctagctttacctcccgagttaaaaaaaaatctttttattttatgccttcataggttgctcgtttcagagtgccacataaataaaatgtttaacaaaa

SEQ ID NO: 31906 - DNA, 3633 bp, Homo sapiens
tgaacgcggccctctgtaatggcggagcgtggcggggacgggggcgagagtgaacgattcaacccgggggagctcaggatggcccaacagcaggccttgaggttccgaggtccggctcccccaccaaatgcagtgatgcgaggcccaccacctctgatgcgacctcctccaccttttggtatgatgcgaggccctcctccaccaccacggccgccctttggacgtcctccttttgatcctaatatgccgccaatgcctcctccaggagggatacctccacctatgggccctccacacctccagagaccacctttcatgcctcctcccatgagttccatgcctcctcctccgggtatgatgtttccaccaggaatgcctcctgtgactgctcctggtactccagcactacctcctacggaggagatatgggttgaaaataaaactccagatgggaaggtttattattataatgctcggacacgtgaatctgcatggaccaagccagatggagttaaggttattcagcaatcagaactgacacctatgcttgcagcccaggcacaggttcaggctcaggcccaggcgcaggctcaggcccaggcgcaggctcaggcccaggcacaagctcaggcccaggctcaggctcaggcccaggcccaggcccaggcccaggcccaggcccaagcccaagcccaggcccaggctcaggctcaggcacaagctcaggcccaggcccaggctcaggtccaggcccaggtccaggcacaagtgcaagcacaagcagttggagcttccacccctacgaccagtagcccagcacctgcagtatccacttcaacatcatcatccaccccttcctctaccacttctaccacaacaactgctacttcagttgcgcagacagtatcaacacccacaacacaagatcagaccccaagttctgctgtttcagttgccacgcctacagttagtgtttcaactcctgctcctacagccacacctgtgcaaaccgttccccagccgcaccctcagacgttacctcctgctgttcctcattcagtacctcagccaacaacagcaatacctgcttttccaccagtaatggtacctccgtttcgtgttccccttcctggcatgccaattccacttccaggtgtattgccaggaatggcccctcctatcgtacccatgatacatccccaggttgctattgcagcttcacctgctaccttagctggagcaacagcagtttctgaatggactgaatataaaacagcagatgggaagacatattattataataatagaacattagaatcaacctgggaaaaaccccaagaactaaaggaaaaagaaaagttagaagagaagattaaagagccaattaaagaaccctctgaagagcctctgccaatggagacggaggaggaggatcctaaagaagagcctataaaggagataaaggaggagcccaaagaagaggagatgactgaagaagaaaaggctgcccagaaggcaaagccagttgctactgctcctattcctggtactccatggtgtgtcgtttggactggtgatgagcgggtcttcttttataatcccaccactcgtctttctatgtgggaccgacctgatgatctgattggcagggcagatgttgacaaaattattcaggagccccctcataaaaaaggaatggaggaattgaagaaactaaggcacccaactccgacaatgctgtcgatccaaaagtggcaattctctatgagtgcaattaaagaggaacaagaattaatggaagaaattaatgaagatgagcctgttaaagcaaaaaaacggaagagagacgataataaagacattgactcagagaaagaagctgccatggaagctgaaattaaagctgcccgagaaagggccattgtccctctggaggctcgaatgaagcagttcaaggacatgctgctagagagaggggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagatccaaaaaattaatccaagaatcagatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccg

SEQ ID NO: 31907 - DNA, 6061 bp, Homo sapiens
cgcggagggatccggaggcgagccgagcgcggtggtgaggccgcctcagcgaaaaaaatgtccgcctgaagagacccacaagttctattcggggggaccgacagcccgccccgggaggaaggggcggccaggcccgaaagccgcctccccctcccagacccgagagctcgtgcggggcaaagtgaaccgagccgctgggcggtgcaaggggaagcccaagcccgttctcccggccaaagtgaactttaatcggggtggttggatgcggagacggggcggcaggacctgctagaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcaggtattgatgaaagaggaggtacaacatcttggggaacaagtggtcaaccaagtccttcctatgattcatctagaggttttacagacagccctcattacagtgatcacttgaatgacagtcgattaggagcccatgaaggcttgtccccaacacctttcatgaactcaaatctgatgggaaaaacatcagagagaggctcattttccctgtacagcagagatactggattaccaggctgtcaatctagtctcctgagacaagatctggggcttgggagcccagcacagctatcttcttcaggaaaacctgggacagcatactattcattctctgctacaagttccaggaggagaccactccatgactctgcagcgcttgatcccttgcaagcaaaaaaagtcagaaaggtgcctcctggtttgccttcttctgtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaatttcttgaattctaaatattactctttctagatttttgaaatcaaaaagttttcagtaaaaagtttcttactttattttattatattaggtagtaaaaaatgtagggttatttaccataacctgttcattaatatcagaaatttacaatagcattttaagaccatagtaggattctagcataccgtgtagtacctatggagtattgtaagagctaattgttggagatgaattgcttctcatcttgttctccagtttccattgttggtttattgcagatttgtatcctgtgtcaaattcaaggtattattgataaaccttttcaaccagcagcaagaagttcaaatttttttctgtcactgtaacagaaaacacaatatgtatataacatttatgtagcaataaatgtgccatcttttttttaacacagtaaaatagtgagttttttacatttctctttctcaaataataatgtattttgttttattttctccatctcattcgtcccagaaacactcacactgcttttcctaactgcattaccgacattatctgggaaacccttcaggacagaatcaggcttgtggagctaagttggcaatctggtctagagcttctctagcttgtgcttttctcctcttgccctcactactgacggtggccttttaaccttttcctaaagattgaccaaacagcaactagtagttatagaaaatctactcatttgtagatacagagaaaaatgaagaagatggaaaaagactcaaaagaggctttttaagttattcttcaaagcacttttcacatttccccataccctttctcacaaaaaaagtgtcataattaagtaatggtattgtttactgtttaaaagttaaaagatcaaaaatttgcttttatcccagtttttaaccacaaaaaaaagcgtagggattatccatgaggacttcatgccaagcaagaacctcaaacaaactagacaaactttttttttgacagtgaatgactttttgtaggacctgtgcgtgcgaaacccatggcaattgtcacatcctcttggtatgctggcagattgcttctcttggtgaattatgaaatccactgttcacattgggtgcctaacagaacattttgcttcttgtgggatttagtgaaaactattaaacttgttaagttgattttatacaaaacgataaataaaaagctctaagaagaaaatgtataatcttagagctgaaataaaatatagagaccatctagtaaatgacctcattaatatatctgtgaaaactgagactcagattgtatgtctctaagaacacataattagtaacagatcaagacacttaaaactttccctacaaaacctccctgccttgactttctctttctctttgcagatttctaggccgcttctgctcagtgtcttcattttcttccatatttgttttatttcatttttcttttctatagttcatgttttctttttccttggaaactcaaaatttaaacacacgtcgtgtgtgtgtgtgtgtgtgtgtctgtgtgtgtgtgacttaaagaatcttaagctttggcattaaatagtcctcgattcaaatctaagctcaacatctgattaacttcattttcctatctgaaaaatggagataacattagaattgtgtaagtattgaatgaaacaatgtatggaaagctcttatggttcttgtcacctaagaagtacttaataaatgataaatatttttaaataaataatattataaccaa

SEQ ID NO: 31908 - DNA, 4786 bp, Homo sapiens
ggcgcggagggatccggaggcgagccgagcgcggtggtgaggccgcctcagcgaaaaaaatgtccgcctgaagagacccacaagttctattcggggggaccgacagcccgccccgggaggaaggggcggccaggcccgaaagccgcctccccctcccagacccgagagctcgtgcggggcaaagtgaaccgagccgctgggcggtgcaaggggaagcccaagcccgttctcccggccaaagtgaactttaatcggggtggttggatgcggagacggggcggcagaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcaggtattgatgaaagaggaggtacaacatcttggggaacaagtggtcaaccaagtccttcctatgattcatctagaggttttacagacagccctcattacagtgatcacttgaatgacagtcgattaggagcccatgaaggcttgtccccaacacctttcatgaactcaaatctgatgggaaaaacatcagagagaggctcattttccctgtacagcagagatactggattaccaggctgtcaatctagtctcctgagacaagatctggggcttgggagcccagcacagctatcttcttcaggaaaacctgggacagcatactattcattctctgctacaagttccaggaggagaccactccatgactctgcagcgcttgatcccttgcaagcaaaaaaagtcagaaaggtgcctcctggtttgccttcttctgtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgaaaaatcgagttgagcagcaacttcacgagcatttgcaagatgcaatgtccttcttaaaggatgtctgtgagcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaatttcttgaattctaaatattactctttctagatttttgaaatcaaaaagttttcagtaaaaagtttcttactttattttattatattaggtagtaaaaaatgtagggttatttaccataacctgttcattaatatcagaaatttacaatagcattttaagaccatagtaggattctagcataccgtgtagtacctatggagtattgtaagagctaattgttggagatgaattgcttctcatcttgttctccagtttccattgttggtttattgcagatttgtatcctgtgtcaaattcaaggtattattgataaaccttttcaaccagcagcaagaagttcaaatttttttctgtcactgtaacagaaaacacaatatgtatataacatttatgtagcaataaatgtgccatcttttttttaacacagt

SEQ ID NO: 31909 - DNA, 4772 bp, Homo sapiens
tccggaggcgagccgagcgcggtggtgaggccgcctcagcgaaaaaaatgtccgcctgaagagacccacaagttctattcggggggaccgacagcccgccccgggaggaaggggcggccaggcccgaaagccgcctccccctcccagacccgagagctcgtgcggggcaaagtgaaccgagccgctgggcggtgcaaggggaagcccaagcccgttctcccggccaaagtgaactttaatcggggtggttggatgcggagacggggcggcaggacctgctagaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcaggtacaatacacgagatgaagcagttaaatagcaaagcaagacagaagggtcagagaattaaaggttttacagacagccctcattacagtgatcacttgaatgacagtcgattaggagcccatgaaggcttgtccccaacacctttcatgaactcaaatctgatgggaaaaacatcagagagaggctcattttccctgtacagcagagatactggattaccaggctgtcaatctagtctcctgagacaagatctggggcttgggagcccagcacagctatcttcttcaggaaaacctgggacagcatactattcattctctgctacaagttccaggaggagaccactccatgactctgcagcgcttgatcccttgcaagcaaaaaaagtcagaaaggtgcctcctggtttgccttcttctgtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgaaaaatcgagttgagcagcaacttcacgagcatttgcaagatgcaatgtccttcttaaaggatgtctgtgagcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaatttcttgaattctaaatattactctttctagatttttgaaatcaaaaagttttcagtaaaaagtttcttactttattttattatattaggtagtaaaaaatgtagggttatttaccataacctgttcattaatatcagaaatttacaatagcattttaagaccatagtaggattctagcataccgtgtagtacctatggagtattgtaagagctaattgttggagatgaattgcttctcatcttgttctccagtttccattgttggtttattgcagatttgtatcctgtgtcaaattcaaggtattattgataaaccttttcaaccagcagcaagaagttcaaatttttttctgtcactgtaacagaaaacacaatatgtatataacatttatgtagcaataaatgtgccatcttttttttaacacagt

SEQ ID NO: 31910 - DNA, 1598 bp, Homo sapiens
agacttactccctttgcctgtgtggatatatgtcttggagagaggctgtgtgcattagctacaaatagtaacattttcaaaatcaacatgtattgtgcttatcctgtccctggaatgggcagcaattctttgatgtattactacaatgggaaaacggtatatgcaccatccccaaattcagatgatttcaaccgtgaatctcctagttatccatctcctaagccaccaaccagtatgttcgctagcactttctttatgcaagagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaaga

SEQ ID NO: 31911 - DNA, 2474 bp, Homo sapiens
acgcgcggtgtctgcgccgactgcagccctcctggacgggagcctctgggcccagcttagggtggcgtccagcgtgacctactcgggaatggcagccttcagtgtcctgcggcctcgggttccgggaagctcggggacctgggcagcggatccagatgcttccacagctgtgtctccgtcgctccgcttcgggggccgagaaccagcaagaccaacgcgaggaggcgccacgaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcaggtattgatgaaagaggaggtacaacatcttggggaacaagtggtcaaccaagtccttcctatgattcatctagaggttttacagacagccctcattacagtgatcacttgaatgacagtcgattaggagcccatgaaggcttgtccccaacacctttcatgaactcaaatctgatgggaaaaacatcagagagaggctcattttccctgtacagcagagatactggattaccaggctgtcaatctagtctcctgagacaagatctggggcttgggagcccagcacagctatcttcttcaggaaaacctgggacagcatactattcattctctgctacaagttccaggaggagaccactccatgactctgcagcgcttgatcccttgcaagcaaaaaaagtcagaaaggtgcctcctggtttgccttcttctgtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttccccc

SEQ ID NO: 31912 - DNA, 1545 bp, Homo sapiens
attttgagaccagacaactggactcatgtcttccaactcaaggtaccagtcagtggccaagacctggagggcaagcaccttcatccccaagctatgaaaactcactccactccctgaaaaatcgagttgagcagcaacttcacgagcatttgcaagatgcaatgtccttcttaaaggatgtctgtgagcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattg

SEQ ID NO: 31913 - DNA, 1809 bp, Homo sapiens
actgaagacttactccctttgcctgtgtggatatatgtcttggagagaggctgtgtgcattagctacaaatagtaacattttcaaaatcaacatgtattgtgcttatcctgtccctggaatgggcagcaattctttgatgtattactacaatgggaaaacggtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgaaaaatcgagttgagcagcaacttcacgagcatttgcaagatgcaatgtccttcttaaaggatgtctgtgagcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggaggg

SEQ ID NO: 31914 - DNA, 4076 bp, Homo sapiens
ggggaagcccaagcccgttctcccggccaaagtgaactttaatcggggtggttggatgcggagacggggcggcagaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcaggtattgatgaaagaggaggtacaacatcttggggaacaagtggtcaaccaagtccttcctatgattcatctagaggttttacagacagccctcattacagtgatcacttgaatgacagtcgattaggagcccatgaaggcttgtccccaacacctttcatgaactcaaatctgatgggaaaaacatcagagagaggctcattttccctgtacagcagagatactggattaccaggctgtcaatctagtctcctgagacaagatctggggcttgggagcccagcacagctatcttcttcaggaaaacctgggacagcatactattcattctctgctacaagttccaggaggagaccactccatgactctgcagcgcttgatcccttgcaagcaaaaaaagtcagaaaggtgcctcctggtttgccttcttctgtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaa

SEQ ID NO: 31915 - DNA, 1544 bp, Homo sapiens
attttgagaccagacaactggactcatgtcttccaactcaagtaccagtcagtggccaagacctggagggcaagcaccttcatccccaagctatgaaaactcactccactccctgaaaaatcgagttgagcagcaacttcacgagcatttgcaagatgcaatgtccttcttaaaggatgtctgtgagcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattg

SEQ ID NO: 31916 - DNA, 1598 bp, Homo sapiens; identical to SEQ ID NO: 31910

SEQ ID NO: 31917 - DNA, 3956 bp, Homo sapiens
gtcttggagagaggctgtgtgcattagctacaaatagtaacattttcaaaatcaacatgtattgtgcttatcctgtccctggaatgggcagcaattctttgatgtattactacaatgggaaaacggtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaatttcttgaattctaaatattactctttctagatttttgaaatcaaaaagttttcagtaaaaagtttcttactttattttattatattaggtagtaaaaaatgtagggttatttaccataacctgttcattaatatcagaaatttacaatagcattttaagaccatagtaggattctagcataccgtgtagtacctatggagtattgtaagagctaattgttggagatgaattgcttctcatcttgttctccagtttccattgttggtttattgcagatttgtatcctgtgtcaaattcaaggtattattgataaaccttttcaaccagcagcaagaagttcaaatttttttctgtcactgtaacagaaaacacaatatgtatataacatttatgtagcaataaatgtgccatctttttttt

SEQ ID NO: 31918 - DNA, 1555 bp, Homo sapiens
ggccgggcggagccctccgcccccggccggggcggccttgccattggcccctccctcgcctataaggcgggggccggcggggccgtgggagcgcgcgggagcgcacggcggggcgcggccgacgctgggacgcggcgcacggagggacgcggccggcgcccatggcgttcgcgctgctgcggcccgtcggcgcgcacgtgctgtacccggacgtgcggctgctgagcgaggacgaggagaaccgcagcgagagcgacgcgtcggaccagtcgttcggctgctgcgagggcccggaggcggcgcggcgcggcccgggccccgggggcgggcggcgggcgggcggcggcggcggcgcgggccccgtggtggtggtgcgacagcggcaggcggccaacgcgcgggagcgggaccgcactcagagcgtgaacacggccttcacggcgctgcgcacgctcatccccaccgagccggtggaccgcaagctgtccaagatcgagaccgtgcgcctggcgtccagctacatcgcgcacctggccaacgtgctgctgctgggcgactcggccgacgacgggcagccgtgcttccgtgccgcgggcagtgccaagggcgccgtccccgccgccgccgacggcggccgccagccgcgctccatctgcaccttctgcctcagcaaccagcgcaaggggggtggccgtcgtgacctggggggcagctgcttgaaggtgaggggggtggccccccttcgagggccacggagatgagcctggaccctggagaaggaggccaggagccagccactggctggacagggaagaagaccccaggagccaagcccaccccttctttgtgtagggaccgggggaccatggcctgttccgggacactctgggcagggccctcgggacatctccacccgatcctggagagctgtgaggatccattcagcctgcccagctctggctggtcagagacaaggcagaacttttggaaaaacaaagactgttggtgacagggtgtgtgtgtatctgtgcgtgagtgtgagtgtgtgtgagagagaattggtgagtttaaaataaaagctatttttaaataaaagacgtcgttctgagctgaggagagtcccgtggacatcggaggtcagaggtgggccctcccctggacctagagagaggcacagatgttctgggggctgccctgagccctggaagggtgggggtggggcgggggaaggcaggcagagccccctctccgggcgccataaccaaactttcctcagtctgctgtttatcagatgttcttaacaactgttaggtgtctgatatggttggtaaagaaatcttaattttacttatttttgaataaggcctgtgttcatttcattcacatggttcaaaactcagaaggtaccagagggtatgtgttgaaaagtctccgtgcccctgtcctccagccaccagctctcctctctgcaagcagcctagggcaccagtttcctgtgatgtcccattcactatgaatgatcaggcaaatacacaaatgacagcacatcgtacac

SEQ ID NO: 31919 - DNA, 3039 bp, Homo sapiens
aggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggattggaggctccccaaatattttgcgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaaatggggaccacgccttctgctccaccacaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccactgccaaggcaccatcggacacacctgcccatgagtagacacagcagcgagcaaataggtctgataaataccccccttcccttccctccccaggagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacacccgccctttcctacctagatttaatgagcccaagtttttaaaatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 31920 - DNA, 3290 bp, Homo sapiens
tccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctactcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgcgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaaatggggaccacgccttctgctccaccacaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccactgccaaggcaccatcggacacacctgcccatgagtagacacagcagcgagcaaataggtctgataaataccccccttcccttccctccccaggagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacacccgccctttcctacctagatttaatgagcccaagtttttaaaatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 31921 - DNA, 3040 bp, Homo sapiens
aggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggattggaggctccccaaatattttgcgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaggagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcttgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 31922 - DNA, 3291 bp, Homo sapiens
tccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctactcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgcgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaggagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcttgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 31923 - DNA, 3040 bp, Homo sapiens; identical to SEQ ID NO: 31921

SEQ ID NO: 31924 - DNA, 2993 bp, Homo sapiens
cccggcttcttggctgtcaaacagatgcagcaacgtcggctcctgccgaggagcccaaggggtcccgggatccgccgcacaggctggcactgcttgaagaggaggctactcggagactgcgccgcgcggattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 31925 - DNA, 3291 bp, Homo sapiens
tccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctgctcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 31926 - DNA, 3291 bp, Homo sapiens
tccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctgctcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggtccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 31927 - DNA, 3281 bp, Homo sapiens
gggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctgctcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 31928 - DNA, 3281 bp, Homo sapiens; identical to SEQ ID NO: 31927

SEQ ID NO: 31929 - DNA, 3291 bp, Homo sapiens; identical to SEQ ID NO: 31922

SEQ ID NO: 31930 - DNA, 3040 bp, Homo sapiens
aggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 31931 - DNA, 2993 bp, Homo sapiens; identical to SEQ ID NO: 31924

SEQ ID NO: 31932 - DNA, 3040 bp, Homo sapiens
aggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggtccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 31933 - DNA, 805 bp, Homo sapiens
actttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaaatggggaccacgccttctgctccaccacaacgcaatcggaggaaatctgttcaccgagtgttggcggaactggatgatgagagtgagcctcctgagaacccgccaccggtccttatggagcccaggaagaaactccgtgtagacaaagccccactgactcccactggaaactggcacatccaagggatgcagagcatcgtgaaaggacagaaagagagaccctggcctcgagaacacctgtcaggttatgaagaggcatcctaattgatttttaaattcaagagatttatcgagcaccttctataagccagcggctatacaaagtggacaaagagccctgacatccagcatgacagaagtgctatttggcacttgttcttcaagttgcccacttggatctcttccaagtgcactt

SEQ ID NO: 31934 - DNA, 1418 bp, Homo sapiens
gagttggcgccagcttcctcggatgtagatattgctggctggatgaccagccacagccagctagcttgagtccaaggcctcctcaggcactgtgtttctgctctgtgggctgcagccccagtggggtggcatgtcacagaggaaggccagagggccaccagccatgccaggggtggggcatagccagactcaggccaaagcacggttgctgccaggcgctgacaggaagaggagccgcctcagcaggacaaggcaggacccgtgggaagaaagaagctggagcaaccagagatggagcagagctacccctggccctcgagggaccagggctgggggcctggctcttggcaggagcgaggccagtcctgagaatgccgcgcgggagcggagccgggtcaggacgctgcgccaggccttcttggccttgcaggctgctctgcctgccgtgccgcccgacaccaagctctccaagttggacgtgctggtgctcgccgccagctacatagcccacctcacccgcacactcggccacgagttgcctggccctgcctggccgcccttcctgcgtggactccgctacttgcaccctctcaagaagtggccgatgcgatctcgtctctatgctggaggcctggggtactccgatcttgactccaccacagccagcacccccagccaaagaacaagagatgcagaggtggggtcccaagtccctggagaggcagatgctctcctttccaccacaccactctcaccagctcttggtgacaaataattatcacactcgcccttttctcctagactgtgactcatgcttatgggcctggattttctaccagcccccagattctcagccatcagacttgactcagactcagctcccaagttccagcatgcagaccaagagaagcagtagcacttctgtgatggacagtacctagaggggcacaggttggagagcctcctccttggtccccaggaggggacttccccatggctcttctgtgacagctactgggaagtgggagagaaagaggtataattgggctcaaagttgaggtagggaaccaccctagctttcttcccctaaggtttctacaaaccctctgcagatagcaaaaaggcaggtgcagagggaggggcctgggatggcaccagccccaggtgctgatgggaaagccaggtggccggataggctcctggtagctccaagtgtaaacagatctgggctgggtcacacagccagaggggaaactgaagaaggaaatgtgctttctaactgcatcatgagatgcttacctgatgttagagagatagtgaggaattcaggattcctccctctgtagtatgggcctttccagaagctgcccctcaccactacattttctctccctctcggctcctgcactcttccactc

SEQ ID NO: 31935 - DNA, 2283 bp, Homo sapiens
agctcccccgcccccgaccccgcgcgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgctc

SEQ ID NO: 31936 - DNA, 1869 bp, Homo sapiens
taggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggaagggagaggaggagaggaacagtgttatttgggggtcacagctctgcgtttgcaggccacgttctttcccatctccaccgaatgtacaagcgcttgcgtgtcggcctctgtggcaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgctc

SEQ ID NO: 31937 - DNA, 1727 bp, Homo sapiens
ctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaagagacagggtcttgctgggttgtccagtctggttttgaactcgtggcctcaagtgatcctcccatctcagtctcccaaatagctgggactaccggcacatgccaccgctaatttattttattttattttttatagaaacaaggtcttactttgttgcccagggtgatgtcaaactcctggcttcaagcgattctcctccctctacctcctaaagtgctaggattacaggcatgagccaccacgcccagccagacacatcctgttttattggaccatggagagtattgctggtctataacatgccctgggtttgcacgtctgagttcttttttttttttttcgagacagaattttgctcttgttgcccaggctggagtgcaatggctcaatcttggctcaccacaacctccgcctcccgggttcaagtgattctcctgcctcagcttcccaagtagctgggattacaggcgagtgccaccatgctcggcaaatttttgtatttttggtagagacggggtttcaccatgttggccaggctggtctcgatctcctgacctcaagtgatccgccagtctcggcctcccaaagtgctgggattacagccctgagccactgcgcccggcctcccaaagtgctgggattacaggcgtgagccaccacacccagcctaagtgttgtttctgcaccatggtatacccaggtcatttcctcaccccaatggtagcatgtgtccagatgttggctacagtccccggtgtctgcaggcatttctgtgaaactgcccaagaatgagtatatatcctgcatgctgccagtgccttcagtagagttacgtggctcacactgagtgtctgcccaggtccttcaccttcttactcgtagtcgacggtagtggtttggaaacctgccgtcgtgtgtgggcagaagtgttggggttttgattgtgggtagatcaaggatgttttcatatgctgttgttcacgccttccctggatttctaacaggttttgctttatattttactttacatttttggtgttgatgggtttcttcgggaatattaattaaaaatagactttaaaatgtc

SEQ ID NO: 31938 - DNA, 620 bp, Homo sapiens
ctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgacctgagcgctcctaagaaatgccgagcgcgctttggccttgatcaacagaataactggtgcggcccttgcaggagaaaaaaaaagtgcgttcgctacatacaaggtgaaggcagctgcctcagcccaccctcttcagatggaagcttact

SEQ ID NO: 31939 - DNA, 667 bp, Homo sapiens
acgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtcagccccctcccttgctgcactcagggacatgactgtcagcacttctaccccccctcagacttcactgtcagcactcaagtcttcagggacatgaaaaggagccactccttacaaaaagttggggagccctggtgtattgagtctaacaaagtgccagtggtgcagcaccctcaccatgtccaccccctcacgcctcttatcacgtacagcaatgaacacttcacgccgggaaacccacctccacacttaccagccgacgtagaccccaaaacag

SEQ ID NO: 31940 - DNA, 1174 bp, Homo sapiens
ttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggcaaggtcaaccagtgtacccaatcacgacaggaggattcagacacccctaccccacagctctgaccgtcaatgcttccatgtccaggtgagt

SEQ ID NO: 31941 - DNA, 1547 bp, Homo sapiens
gggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacagacctgagcgctcctaagaaatgccgagcgcgctttggccttgatcaacagaataactggtgcggcccttgcagtctttgaatttggaatattacaatggagaaaaaaaaagtgcgttcgctacatacaaggtgaaggcagctgcctcagcccaccc

SEQ ID NO: 31942 - DNA, 4021 bp, Homo sapiens
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtcagccccctcccttgctgcactcagggacatgactgtcagcacttctaccccccctcagacttcactgtcagcactcaagtcttcagggacatgaaaaggagccactccttacaaaaagttggggagccctggtgtattgagtctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 31943 - DNA, 4073 bp, Homo sapiens
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacagacctgagcgctcctaagaaatgccgagcgcgctttggccttgatcaacagaataactggtgcggcccttgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 31944 - DNA, 1274 bp, Homo sapiens
caggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgacctgagcgctcctaagaaatgccgagcgcgctttggccttgatcaacagaataactggtgcggcccttgcagatgcaaatactccaaagaagtgtcgggcactgttcgggcttgaccgacagactttatggtgcaaaccgtgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaa

SEQ ID NO: 31945 - DNA, 738 bp, Homo sapiens
caggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatggagaaaaaaaaagtgcgttcgctacatacaaggtgaaggcagctgcctcagcccaccctcttcagatggaagcttactagattcgcctcccccctccccgaa

SEQ ID NO: 31946 - DNA, 1041 bp, Homo sapiens
gcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtccagagccccctcccttgctgcactcagggacatgactgtcagcacttctaccccccctcagacttcactgtcagcactcaagtcttcagggacatgaaaaggagccactccttacaaaaagttggggagccctggtgtattgagtctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggtgagt

SEQ ID NO: 31947 - DNA, 3802 bp, Homo sapiens
ttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacagacctgagcgctcctaagaaatgccgagcgcgctttggccttgatcaacagaataactggtgcggcccttgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 31948 - DNA, 1992 bp, Homo sapiens
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacagacctgagcgctcctaagaaatgccgagcgcgctttggccttgatcaacagaataactggtgcggcccttgcagatgcaaatactccaaagaagtgtcgggcactgttcgggcttga

SEQ ID NO: 31949 - DNA, 4022 bp, Homo sapiens
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgacctgagcgctcctaagaaatgccgagcgcgctttggccttgatcaacagaataactggtgcggcccttgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 31950 - DNA, 4000 bp, Homo sapiens
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 31951 - DNA, 1920 bp, Homo sapiens
atgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtcgcagtgctgtagctatcgatagaagtcttgtccagggaaacaatccaccattagctgggagcaaggccttagacagaaaggagcaacattcaactaaggaagaccccggccacgtctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccagctttctgtcttctaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacagacctgagcgctcctaagaaatgccgagcgcgctttggccttgatcaacagaataactggtgcggcccttgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatag

SEQ ID NO: 31952 - DNA, 4022 bp, Homo sapiens
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgatgcaaatactccaaagaagtgtcgggcactgttcgggcttgaccgacagactttatggtgcaaaccgtgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 31953 - DNA, 4073 bp, Homo sapiens
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacagatgcaaatactccaaagaagtgtcgggcactgttcgggcttgaccgacagactttatggtgcaaaccgtgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 31954 - DNA, 973 bp, Homo sapiens
tgataacacacgccggagggtcgcacgcgggttccagttgtgattgctggagttgtgtattgccaggaggctctccgagattggggtcgggtcactgcctcatccaccggagcgatggcgtttctccgaagcatgtggggcgtgctgagtgccctgggaaggtctggagcagagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagatgcaaaaactacagaactaattagaagaattgcccagcgttggagggaacttcctgattcaaagaaaaaaatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagaaaagctgaagactgtaaaggaaaactggaaaaatctgtctgactctgaaaaggaattatatattcagcatgctaaagaggacgaaactcgttatcataatgaaatgaagtcttgggaagaacaaatgattgaagttggacgaaaggatcttctacgtcgcacaataaagaaacaacgaaaatatggtgctgaggagtgttaaaagtagaagattgagatgtgttcacaatggataggcacaggaaaccagttaggtctcaatacctgaagctatcgtaaaattaagaaaggataaagttggtaaaccttttatatttagtatctttttattcagctcatggacttctgccagcataatacttgctttggaaaacccagataaaggttcatgcaaactttattttgtgtttaggaac

SEQ ID NO: 31955 - DNA, 663 bp, Homo sapiens
agagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagatgcaaaaactacagaactaattagaagaattgcccagcgttggagggaacttcctgattcaaagaaaaaaatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagagttaacactgcttggaaaaccaaaaagacctcgttcagcttataacgtttatgtagctgaaagattccaagaagctaagggtgattcaccgcaggaaaagctgaagactgtaaaggaaaactggaaaaatctgtctgactctgaaaaggaagtgagtattacggttgttagtctcaagtgtctacttaggatatctgtgagagaatgtattagggcaaggcttgattcatgtgaagacaaccttgtattactaataatacaagtattctaaaatta

SEQ ID NO: 31956 - DNA, 5414 bp, Homo sapiens
ctgagacgctccgctgggcgcgcagcagccgccgatcggacctcggggtcctggatgcaggactgtctgttacgtacagcccttgtgaccgtcacgggcggacaccggccaacgccgggttggggtgaggccgccgccgcggtccctccatcaccctcctggcccggcagaggaacccactgctccgggcggccggggacagaggtggctcaacagcgccgcctcgaagccagagccctccgcaggctagaggattgcggtttcccttcatctccgcggctcttattcctcccccgcaaggccgcccaccggggtacgctctcccgcgcctgcgccaattccgccccgccccgcccccatctaccgaccggatgttagcagatttcccatagtgcctcgctagtggcgggcatgataacacacgccggagggtcgcacgcgggttccagttgtgattgctggagttgtgtattgccaggaggctctccgagattggggtcgggtcactgcctcatccaccggagcgatggcgtttctccgaagcatgtggggcgtgctgagtgccctgggaaggtctggagcagagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagatgcaaaaactacagaactaattagaagaattgcccagcgttggagggaacttcctgattcaaagaaaaaaatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagagttaacactgcttggaaaaccaaaaagacctcgttcagcttataacgtttatgtagctgaaagattccaagaagctaagggtgattcaccgcaggaaaagctgaagactgtaaaggaaaactggaaaaatctgtctgactctgaaaaggaattatatattcagcatgctaaagaggacgaaactcgttatcataatgaaatgaagtcttgggaagaacaaatgattgaagttggacgaaaggatcttctacgtcgcacaataaagaaacaacgaaaatatggtgctgaggagtgttaaaagtagaagattgagatgtgttcacaatggataggcacaggaaaccagttaggtctcaatacctgaagctatcgtaaaattaagaaaggataaagttggtaaaccttttatatttagtatctttttattcagctcatggacttctgccagcataatacttgctttggaaaacccagataaaggttcatgcaaactttattttgtgtttaggaactactgaggatcagagtaatccaagcaaatgtgaatcattttacctttgacaaaggtaaatcagactatgaagttttttttatacaggatgatgactatggaaagagtactcttgtttccttatattatggaggcaggagtttcgttttcaaaattgttacaaattgtagaagccacggtgttctgtgatataagtgtgtgtttttcataaagcaggcagaactcatctaggtaaattacagttcctaggtataattcacattgtattcagagttgatggttgtacatataagtgattgctggttttagttgcaactttgtataaaagggactgagaaatttataaacttttttcttactgtcttttttctaaagtaaaaacaaagaaattatgtgccagatttatgcatattattttatgttgcatagaataaaatttttaatctttaattttacatttcctaaatatattttaagacgaaacatttgttctatagcttttccctttttttaagtaaggaattttatttttttctgaattattttctctcgtgagtatattgatccagaaagaaaacttgtattatgtgtgttttaaaatgagaaatctaaaaaacgaaaagtctccaaagtctctggaatttgaaacactttgcataacgtataaaagcctgtttaagagacagccaactatggcctgtggatcaaatccagcctgctgcctgctttttatggcctgtgagctaggaattgtgtttataattttaaatgtttttttttaaagacttttatgatacttgaaaattaacatgaatatttagtgttcataaataaagtttgttgaaacacaaccaagatcattcttttacttgtctatggctgcttttctgtggcagagtagctgccacagaaactatagcccacaaagcctgatatttactgtctgtctgtttatggaaaaaatttatcaacccatggtctatagtatagtgtgatatgactactgttccaatgtattgaagtgttgggatagttttttcaaatgttttcagatgttcttgttttagaatcattgtcacctttaagaggaaaaaggtcatcactagataatctaaacaaattgttgcttctcagtgttagcaaggaaaataatctagtttcaaattacattgcagtataatgaaaaagatccatatactgtggaatgatattcttttaaaattatttgctatggcttggtaaaaatgtactttttccagtagcacatatcacaagaacctcactgtagttgaaagccatctttctttagtatttgtttatccttttaggagagtcaagcaaaggttttcaccacctgtttgagcagaataattctcatcagttcacagatataggataactcaatttatatgcactttatgcgttatgcaaaatatttagaaattgtagattctagatctccagaaagactttgaagactttgatgtcacaaaaagatgacttgttatatgctgagcttgacaaaggtaggaatgggagagaaaaatagtagcttatgaggaaatatgaggctttaaatatataaagttggatattttaaaataacttttccctgtgggagcttctcactctgggtgcagacaggacagtgttggccattggtgaaatagataggatgggtttgaggccagagcagtctgggagtagggggaaagagaaggaggtgtgctagtgtctatcacaggctttctcaattaggtttgcaggagaaaaagccctaagtccctgtgtcatctagaatggtactaattatgtacagtccctaggagaatggagaaaatcataactcaaatcatcgactcaattctgttctcttcagatgagctcagagagcacataggagtgtttgtaatgaggggtatgtaatgattgagatagaggaatgagttacataaacatctcgggacaaatgcagcatagaaaacatctttgtagttaccctgcggggaaatttcctctgagttcttttaacattaactacccgtattattttatacttaacattcatatcataccttcccaaatatattgggaagttcagtgttaagtacgtttctcaagtacttaacaacttaatatagggaggaaaggtgtaaacagtgaaaaaagagcaaaactattttatggtaattttatggtagtatcagcttgtatttggttctctgtttctaaaataatgtaatttttaatattttaaataataggataacctggtttccaagcctttttttcccccgacatccagaatacacactggatccaagcctttcttaaacatcagtacatgtggaagactggcatgccatataccaaatgccattcagctgtaacagtatacacagattttctcttataaagaataagaacatcataaccaatgaccactcatataaagtcttatttgtgtgtgtgtgtgtgtgtgtgtgcacgtgtgtgtgttagagtctcattatattgctcaggctggagggcatggtgtgatcttggctcactgcagccttgacctcctgggctcaagtgatccttccgagtcgttgggactacagtaggtgaacaccaccatgcctggctaatttttgtattttttttttaatcaagatgggatcttgctatgttgcccaggctggtctcaaactcctggcatcaagcgttcctccttccttggcctccttaagtgctgggattataggtgtgagccaccatgcttgaccataaagccttactatttcttttggagacacagtcttgctctgtccaagctggaatgcagtgatgtgatcatggctcactgcagccttgaactcccaggcttaagagatcctcccatctcagcctcctgagtagctgggattataggtgcagaccatcaagccttgctattattttttagacttttcttaatttcatccaacaaagtagttgctgtaggagctgagtgttagaaggaaagatgctgaagaaatgaaatcaagcagggtgtatactgtcatgaataggcatacagtagtttttatacttttgttctttggagtaccaatgttaggttttacaaaagtaatttgatgaggggaaggagggttgtgtatttattttactttctgatgtttgcttaaataatactgtgtacgtattcagcttgctgtaattctgtaattacgctattgcgtttggctaactcctttttggaaatgtctttttttttgtacaaggcatgtgttagtttttactaattgctctgaatgtgtatatttagatttctgaattgaaaaaaaatagcgtacaataagtagatttaaagtaattagaacactttattgatttttctgatgttttctgtatctaaaatttatcaccaccaggttgtgctaaaacagcaggaagtttttatattgtgagtgacagtacccattatttctcttaattttactaacatttactataagaatattctctcgctcttttctccactcacagccattctccctccttctcttcataacatcaagctgtcacagacaaatctgaaaatgttacaagcacagactatgttgtatgttttgaaattttagaacagtaatgttctttttaaaattgaacttctgcagagtaagaaaatgaatacatttattactttaaatttgtaaaattttccaaagtaaaaccatacaaagctagtgtcagtctctctcattgttcacaaataaaggacttttgttaattgattaaatcacttactatattcgatatgaaatatataaaacatacaaccattatctaatacatttcagaatgtttcactggttacaggagccagtaaataaagttgactctaaacaggaattttaaataaactaaacattttttcatcaccaag

SEQ ID NO: 31957 - DNA, 2035 bp, Homo sapiens
tggcggagtgaattcctgggccagcgcgcatgcgtcggcaggtagcaacccagctctttatgaccaggtgagatgttggtgagcaggtaaaaaaggaggatttgcctaagcgattccagggagctggcccgaccgagccctccagcccatgcccggcggggaccagtcgccaggagcgcagagccgcgatgtccatacttgccaaaatgggggactggcaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaagccaaaagatgatgacaacatttttatcagtattgtgaataaa

SEQ ID NO: 31958 - DNA, 3300 bp, Homo sapiens
acgggagctctttcccttctctcctcctcctcgcccttctcctcgccctcctcctcctcctcgccctcctcttcctcctcctcctccttgccctcctcctctccctcctccttctcctcctccacctcctctccctcctcctcctcctcctgcgctcaccgccggcagccagcactttgcgctcacccagagagtagctccacttgggtgcgagaccgagaggggcatatccgttcacgccgatccatgaaaatgctttggaaattgacggataatatcaagtacgaggactgcgaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaagccaaaagatgatgacaacatttttatcagtattgtgaataaacttgaacacaaatacacgaagttccatgtcatgtcttcagttgtagaagtttttcctctttaaggtaaagcgaccaacttgaactttctctggcaacacgattcgcagttatataagggaatcagtgttcacgtctctgtatatatttatttatgtgtaatttaatgggaattgtaaatatggtgagtctgttttaagcctttttttttttatttatctgatcttgtttacctcttgtttagtgggttttgaatcttccctattagttcttcatgtggttcatggtactgatttagaaatccagtgtttgggggatttttttctctgggattcatgaatttagccctgttgtagcatgttaaaggtgacaaacagctggacaaatttttaaaaagtaaaataaaattttatctataattagtattattacatttagcttttcattgaaccgaaagaaaaaaagtgatattggaccctggaaagattttgaaacttgagtggtttgataacccttctatgtattgtagggagaaaaaaaaaagtttattttattccactgtcctcccttaaaagcatcatttgagcaataaatgaatattgtctttaaaccaagggttagggaattttcctctctctctctctctcctctctctttctgttcaaagaacttcaaacatttgggaccacctggtattctgtattttcactggccatattggaagcagttctagttgcattgtattgagttgtgctggcagtagtttccatgcctgtcaatgtatcatagtcctttgttgcccagataaataaatatttgatacgctttatgtcgatttttttttattcagtggctgtctttacccaggcgtatttttgttcttggcagtattttttattcagtatggttacagtaattgagtttaactctcccttggcaattgctccttgcaataagcagctgaacccattgtttccctcaagtataataaaaacttactttcaacttggagttcagagcagggtatcatttagatattccactgtgtctgtattcagacaaatgacacaataaaacccaatgtattcttttggataaaagattgtttgtactgctaaaggaatgacatactgtcttttccttactagaaacattaattttattattaaaaataaagttttattttattta

SEQ ID NO: 31959 - DNA, 2576 bp, Homo sapiens
cacgcacgcagacacattctccctctctgcgctctctccttcggtctccctctctgcctctttctctttcacttttgcatgccctgcaaccttttaaaatgttgccccttccctgtgattcgccagacgccgcgccgcggccccccgcgcgctcgcccgctccctctctcgctcgctttttgtctctcgcgctccctctccccactccgatttgctacactgagactcccgtcaatggactgcattgagagccggctccggcgcgagttgcctctccgcttcacgctcgatttccaggcattcttcccttattaagtattcgtgtaatattaatagtcatgaatatctgctattaggaggctccaggaacgctgcccagcgcggttattagaagctcaagcgaagccgccgctaagaaaagagggggagacacggattaaggaacacgcacgcacccacacactcacacatactttttcctttttccttttttggggtttttcatttttaaagaactttgaatcataaccagtcgcggcaggatagagaccgtgggttcgaccagctgaaggcgccgcgcgaatcggtggttcaagttcggatggatccgagccgggctcccgcgctccggggagcgtcggcgccgtgactggagtcctgggtggcgcggggctctcggcgccttttgtgtggggcgcgctcgggcggcggggcagccgggcgctccaggcttgcttgtttttttccaccctgactcgttaccccagactcttcgcagatgttagttcacagtttttcagccatggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaa

SEQ ID NO: 31960 - DNA, 3317 bp, Homo sapiens
tccgagcgcacacgggagctctttcccttctctcctcctcctcgcccttctcctcgccctcctcctcctcctcgccctcctcttcctcctcctcctccttgccctcctcctctccctcctccttctcctcctccacctcctctccctcctcctcctcctcctgcgctcaccgccggcagccagcactttgcgctcacccagagagtagctccacttgggtgcgagaccgagaggggcatatccgttcacgccgatccatgaaaatgctttggaaattgacggataatatcaagtacgaggactgcgaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaagccaaaagatgatgacaacatttttatcagtattgtgaataaacttgaacacaaatacacgaagttccatgtcatgtcttcagttgtagaagtttttcctctttaaggtaaagcgaccaacttgaactttctctggcaacacgattcgcagttatataagggaatcagtgttcacgtctctgtatatatttatttatgtgtaatttaatgggaattgtaaatatggtgagtctgttttaagcctttttttttttatttatctgatcttgtttacctcttgtttagtgggttttgaatcttccctattagttcttcatgtggttcatggtactgatttagaaatccagtgtttgggggatttttttctctgggattcatgaatttagccctgttgtagcatgttaaaggtgacaaacagctggacaaatttttaaaaagtaaaataaaattttatctataattagtattattacatttagcttttcattgaaccgaaagaaaaaaagtgatattggaccctggaaagattttgaaacttgagtggtttgataacccttctatgtattgtagggagaaaaaaaaaagtttattttattccactgtcctcccttaaaagcatcatttgagcaataaatgaatattgtctttaaaccaagggttagggaattttcctctctctctctctctcctctctctttctgttcaaagaacttcaaacatttgggaccacctggtattctgtattttcactggccatattggaagcagttctagttgcattgtattgagttgtgctggcagtagtttccatgcctgtcaatgtatcatagtcctttgttgcccagataaataaatatttgatacgctttatgtcgatttttttttattcagtggctgtctttacccaggcgtatttttgttcttggcagtattttttattcagtatggttacagtaattgagtttaactctcccttggcaattgctccttgcaataagcagctgaacccattgtttccctcaagtataataaaaacttactttcaacttggagttcagagcagggtatcatttagatattccactgtgtctgtattcagacaaatgacacaataaaacccaatgtattcttttggataaaagattgtttgtactgctaaaggaatgacatactgtcttttccttactagaaacattaattttattattaaaaataaagttttattttatttatgttga

SEQ ID NO: 31961 - DNA, 987 bp, Homo sapiens
atgctttggaaattgacggataatatcaagtacgaggactgcgaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagaggacagatatgcaaagagttcaccgacctgctggctcaggaccgatctcccctggggaactcacggcccaaccccatcctggagcccggcatccagagctgcttga

SEQ ID NO: 31962 - DNA, 2071 bp, Homo sapiens
gcagattaacacagctaaaagtcggttcccggtgatttattttgatgcacgcacgagacggtatctagacttgcaggcacacacacgtctgtttttaggctcaacttcagaagcgggtgtgcagttccataggagttctgtattcgtgtccacgttgcacccaggaaaccttagcctgaacaccaatttgaactgtcagttggccctagcttcacacaaacaggagaaaaattgtttaacccctggagctgtcaagtaacctcttcaggccagcactttgcgctcacccagagagtagctccacttgggtgcgagaccgagaggggcatatccgttcacgccgatccatgaaaatgctttggaaattgacggataatatcaagtacgaggactgcgaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtg

SEQ ID NO: 31963 - DNA, 5797 bp, Homo sapiens
ttctctttgctgaggcttacttgtccagcctattgtttgagacaacagatataagttgcgatgggagaggagcgtcggatttggtgtgtatcccccatttccaattatagatggatcattacagacagcggagtcctgagaagccagacatctgctcctcacatgaatgcactcacctcctagagaccaggctgccatcatgctctggaagcttgtggagaatgtcaagtacgaagatatctatgagatgttagtccacacctattcatccatggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccagtcagttgaagatgccaataacagcggcatgaatctattggaccagtctgtcattaaaaaagttccagttcctcccaaatcggtgacttctctaatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaagagccaaatcgaaaaatggggggagatctttgcgagaaaggctagaaaaaatcggtttgaatttacccgcgggcaggcgcaaagcagcaaatgtcacgttactcacctccctggtggaaggagaagctgttcacttagctagggattttgggtacatttgcgaaacggagtttcccgccaaagccgtctctgagtatttgaaccggcagcacacagacccgagtgacctgcactcccgaaagaatatgctgttggccaccaagcaactttgtaaagaatttacggatctactggcgcaggaccggacaccgatagggaacagccgacccagccccatcctggagccggggatccagagctgcctcacgcacttcagcctcatcacgcacggcttcggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaatttttaaaaaaagaaggaaaaatgttttaaatacaaaaggaaaaacagacaaaaatttaattttagctttaaaatattggattggctttggaagaattatattaggtagaatacacatacaatcaaaattttaaaaaaaaaagctaaataacttaaaaaaaaactgaggcgtacaacggagcaacaatatcggttctcagtgtctatttcaagatacatttggagacaaccgtccggattttccacttcggttctttcgagtttagtaatactgataataaaagaaaaccatgatttccccttccctttggaaaataaacataagactaaacatgagaaaaacgctaacttattggaagaaaatcggagaaacgttggtgtcaatgctttgagagctggttgactgagacgcacgaactttttaattttaaatatatttttaggaaactctcgcagtccccgccctccatctcacctcacccgtctcccaaccacccttttccatgttaccctcccttcctcacattgttacgggaatcttctgggatgaaaatgagtgtggttggcccttttgcgttgtttcagtcctctcggtacctccccgcccagccctgcgatcttaactcaccgggcccggctccccggccgcttgcataattagggagggcgagggcggggcgggaggcctgtggagaccaggcggaggctgcaatttttggtgccggccggcagagcaggttctggcggctgaggaaaatccggaccaataagttgattcaaacatcatcagttcctttcagaaatgttactagctcccagccttgccagcatctgcatagagagaatctcacatttattatatttgtgtcatctactaattttatgaactatagtaaaaaaaaaaaaacacacacacacacaatatgaatacgttgattagtatgtaattccttcggaggggtatgtaccatttcattctcttctgttttccaaagctttgcccgcatggtttatgagcttcttcaaagaggacttgggcttcctacacaatctataaggtacagagaaaaaaaaatccgatccctttttaatcaaagcctgtgtgtcagaattctgcaggtgcacttctttaaagaagctcaaagggaataatttagaaagtggccaatatgatggaagcagctttgaatctacatgctaacattcctcaacactccaattccggtggaggtggcaggggagggggtctgcaaaatgaattttaagggaaaagagtaaggattcttagagccctatattctaatagtattgccctgcatttaaaattgatttgatttccctgggttctttggtgattgctgtttaagcaaggaaagaagcagctttacgagtggacgtggggaggagggcggcacaagcacccacatttctgtaacaattgctttcttacaagatgctttatgaatgaggcatttttccctcccagacgtgcacttgttttggcatataatggcaaaataatgcaaagtgaagggagatgtatttcagctttgatttttaccgtctggatacatcgggactattcccagtggataaagtttcatgcatttaatatttctcacttctggcagcccagctcctttcttgggctccatcttagcattatcatgaaataagatctggaatccattgtctgcacctccgcaaaagcagtgagaaattatcccgggataagggtgaatgagagaggtctctaaatatagtgttgatacactcacctatttaacaaagtagacgagatctttgcaataccccttaaagataacgacatagatgttgttctgcaggatttatagttaggacccactcaattctccaggactcccggttttgcccccctcccgctttgccttggtgggggtggggattgggggagtggggattgcgttggggttttaggaatctgctgagagctttgcccatttttattaaaagaggaaagggaagttaggaagctcgtctcaggtcaccaaaagggcccaagcaactgttagggccacactgcagcccatctccaacccctagcttcgtttagcacttctgatcttcatggcccagccctagaactgttgagaggaatgcaatggccaagagctagacgttacggagagtgtagtcactctcttttcccagctcagaggcctgcgccttcgtccgagagctcggccgatcgcattagatgtgttctgattgcacaaggccaggagagaccacactgaaaacgatcgtctcctttccttgcagggcaacgcgccccacgcgtgtgacgtgcgagagacgcgatggacgcgccttgctcttactgtgcaggtcctgagagcgtgtgggccacaggcgcccagtcgtgttgaggacatagaatcagccgctggaggggctgccgactgcgcgggcccttcccgctctcggtctcaccctaagggctaaggcgaccgagaaagccccattctccagtaggtaatggggcggcgcccggtgggctgcaggtggggagggctcccagcgccgccagcggccacccggggcgccggctcctggagggagagtggcctagaaatatccaaggaatccgaagcttcccctcctccacctctgccagtacggaaacaccccaccgtcacaatcctaaagcggggagatgggatgggaattgtcttacttggcaaggcagggtaccttcattgccagacgccctcatttgtgtgttcctccttgctccagcgagatagaaccttttgcgcccccaaccccgtttcgtggagtgagcccactaccccttctccctccctcacttctcctttcatgtaggacccccgcccccttgctttccttagccaggcccgctacatttatctgataattgagttattaaaagatttggtttccttgggcctataaatcaataaacagtaggattaacgcaatagtttgccttttaagtcaagggagacgtttaaggcaagcccctttgagctttgttttcaaaccaaacaggtgagttgcagctctccccccggcccctgcactcttcagacatttggtccctgcccactcctaaacgctcagtcccaaaacaaaatagcgaaagacaggaggagtcaggatgtggcagtgctgccttcacactttccacttcgcaagttcttttaaaggttccaaagatctccagaccattctctgccaaaccctgccgcctcctgcacgtattgcaggtctctggggagcaagaaatgtcctgtttgggtgaggattccgtcacctaaaaagatctttaacttctcccccaaagtgggaaggtaactttctcccccttttccccaccaccttcactcctacacccccaattaccttgcattttctttccttccttctggcctccacacccatagctttcctccatccccacttaaagaaccgaagaggcttttaaagacctggctgctttgttttccttggccaaggaagccactttctctcaagcaattatttcatatcctacgaaaactttggtcgaatggaaaactcgaaacctcgagcttatctacacactgttcctctgctacaatgctttcctagttaagagtgtttatagagaatttgtcatcacatctgatatcctgtacttgtaatacattatgtggaaaggaaataaccttaaaccgtctgatgttgcctcaagagcccaaacggcgtttccccacctttgacgatgtatgtgaaattactggcttaaaaaaaaaagtatcaatttttttttaacggaatgaacactatccttctttaaatgccaaaatcgactccacctttgagttggtctctaattctctaacattgtttttgccacacaatcaagaaatatcaatctattgactcttcacgagaagagctctggagggtattcatgttaagtttgtatatatttatttatgcttaatttaatgggaatgtgtaaatatggcgagcaagtagtttgggattatttatctgtgaatctatacctctgtgaatgggtggttaaaaaacctcttgaccctagatagaatcctatctgaatttttctgttctttataaacaagctgttatggtaatgggtagaaattggtttattgtccagtgttaatctgatttacataaataaaaagattgttgtgttttca

SEQ ID NO: 31964 - DNA, 797 bp, Homo sapiens
tttttctctttgctgaggcttacttgtccagcctattgtttgagacaacagatataagttgcgatgggagaggagcgtcggatttggtgtgtatcccccatttccaattatagatggatcattacagacagcggagtcctgagaagccagacatctgctcctcacatgaatgcactcacctcctagagaccaggctgccatcatgctctggaagcttgtggagaatgtcaagtacgaagatatctatgagatgttagtccacacctattcatccatggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccagtcagttgaagatgccaataacagcggcatgaatctattggaccagtctgtcattaaaaaag

SEQ ID NO: 31965 - DNA, 1898 bp, Homo sapiens
tttttctctttgctgaggcttacttgtccagcctattgtttgagacaacagatataagttgcgatgggagaggagcgtcggatttggtgtgtatcccccatttccaattatagatggatcattacagacagcggagtcctgagaagccagacatctgctcctcacatgaatgcactcacctcctagagaccaggctgccatcatgctctggaagcttgtggagaatgtcaagtacgaagatatctatgaggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccagtcagttgaagatgccaataacagcggcatgaatctattggaccagtctgtcattaaaaaagttccagttcctcccaaatcggtgacttctctaatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaagagccaaatcgaaaaatggggggagatctttgcgagaaaggctagaaaaaatcggtttgaatttacccgcgggcaggcgcaaagcagcaaatgtcacgttactcacctccctggtggaaggagaagctgttcacttagctagggattttgggtacatttgcgaaacggagtttcccgccaaagccgtctctgagtatttgaaccggcagcacacagacccgagtgacctgcactcccgaaagaatatgctgttggccaccaagcaactttgtaaagaatttacggatctactggcgcaggaccggacaccgatagggaacagccgacccagccccatcctggagccggggatccagagctgcctcacgcacttcagcctcatcacgcacggcttcggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaatttttaaaaaaagaaggaaaaatgttttaaatacaaaaggaaaaacagacaaaaatttaattttagctttaaaatattggattggctttggaagaattatattaggtagaatacacatacaatcaaaattttaaaaaaaaaagctaaataacttaaaaaaaaactgaggcgtacaacggagcaacaatatcggttctcagtgtctatttcaagatacatttggagacaaccgtccggattttccacttcggttctttcgagtttagtaatactgataataaaagaaaaccatgatttccccttccctttggaaaataaacataagactaaacatgagaaaaa

SEQ ID NO: 31966 - DNA, 1711 bp, Homo sapiens
agggagctgcttttgtgcagagggaaaattttgttcctacaggtttttaagtgggtacgaggcaaggagctatctgatccgggcaaaaccattacaatttagatatctacctatagaacattttttttttcctttaaaaattggaaaatacaagaagtttggatttttttttcccgattctttttttggagggggaaattgcatcgtaagctttcggagaaacccaacatgtcaactacctttccgggactagtccacgatgccgagatacgtcacgacggatcaaacagctaccgtttgatgcagcttggctgtctggagtcagtagccaattccactgtcgcctattcctcctcctctcctttaacttactccaccaccggcaccgagtttgcgtccccctacttctccactaaccaccagtacaccccgctccaccaccagtccttccattacgagtttcagcacagccacccggccgtcacccccgacgcctactctctgaactctctccaccactcgcaacagtactaccagcagatccaccacggggagcccaccgactttattaacctgcacaatgcgcgggcgctcaagtcgtcctgcctggacgagcagaggcgggagctgggctgcctcgatgcctaccgccgccatgacctgtccctcatgagccatggctctcagtatggaatgcacccagatcaaagactcctgccagggcccagcctggggctggccgccgcgggagcagacgacttgcagggctctgtggaggcccagtgtgggcttgttctcaatggccaaggtggagtgataagaagaggtggcacctgtgtggtcaaccccacagacttattttgctctgtccctggccgtttgtcccttcttagttctacttccaaatacaaggtgaccattgctgaggtaaagaggcgcctctccccacctgagtgcctcaatgcttcactcttgggaggcattttgagaagagcaaaatcaaagaatgggggccgctgcctgagagagaaattggataggcttggcttaaacttaccagcaggaagacggaaagcagctaatgtcaccctccttacttccttggttgaaggggaggctttgcacttggctcgggattttggctacacttgtgaaacagagtttccagccaaagcagtaggagaacatcttgccagacaacatatggaacagaaagaacagacagcaagaaaaaagatgatcctggcgaccaaacaaatctgtaaagaattccaagacctcttgagccaagatagatcaccactgggatcctccagacccactccaattctagaccttgacatccagagacatttaacacatttcagtttgatcactcatggctttgggactccggcaatatgtgcagctctaagcactttccaaacagttctcagtgaaatgctgaactacttggaaaaacacactactcacaagaacggcggagcggcggattctggccaaggacatgccaactcggagaaagctcccctgcggaaaacttcagaggctgccgtgaaagagggcaaaacagaaaagacagactagctacatcaaacagaatctatttccagagagtcttgctgctgatattttttctaatatatatatcattgagggtgactaatcttcagtggaccaaatctctacccttccccaaccctccataaaa

SEQ ID NO: 31967 - DNA, 2189 bp, Homo sapiens
gtgcccgtccgtcctgcctccatggacccgcccgggaacggccaccgctgaggaccccacgcccactaggatcccggctgggtcgcacccagctaccgcaccgtgacctccgcgggctgtgccggctcccggcgcctctgcccgcagcgctcgccgtcgggctagggctccgccgccgccacgcctcgcgcccggcactcaccgccccatgctggtgcacacctactccgccatggagcgccccgacgggctgggagcagctgccggcggggcccgcctgtcgtctctgccccaggcggcctacgggccggcgcccccgctctgccacacgccggccgccacagctgccgccgaattccagccgccctacttcccgccgccctacccgcagccaccgctgccctacggtcaggcgcccgacgccgccgcagcctttccccacctggcaggggacccatatggcggcctggcgcccctggcgcagccgcagcctcctcaggccgcctgggccgcgccccgcgcagccgcccgcgcccacgaggagcctcccggcctgctggcaccgcccgcccgcgccctgggccttgacccgcgccgtgactatgccactgccgtgccccggctcctgcacggcctggccgacggcgcgcacggcctggcagacgcacctctcggccttccggggctggcggcggcccccggtctggaggacctgcaggcaatggacgagccgggaatgagcctcctagaccagtccgtgatcaagaaagtgcccatcccctccaaagccagcagcctctcagccctctccttggccaaagacagcctggtgggcggcatcacaaatcctggtgaggtcttctgctccgtgcccggccggctttcactgctcagctcaacgtccaagtacaaggtgacggtgggggaggtgcagcggcgactctcgcctcccgagtgcctcaacgcctccctcctggggggtgtcctccgcagggccaagtccaaaaatgggggccggtgtttgcgggaacggttagagaagattgggctcaacctgccagctggccgtcgcaaggccgccaatgtgacgctgctgacttcgctagtggaaggagaggccgtgcacctggcccgagacttcggttacgtctgtgagacggagttcccagccaaggcagctgccgagtacctgtgccgacagcacgctgacccgggggagctgcacagccgcaagagcatgctgctggctgccaagcagatctgcaaggagtttgcagacttgatggctcaggaccgctcaccgctgggcaacagccgcccagcactcatcctggagcccggagtacagagctgcttgacacactttagcctcatcacccatggcttcggtgggcctgccatctgtgctgccctcactgccttccagaactatttgctggagtcactcaaggggctggacaagatgtttctaagcagtgtgggcagtgggcatggtgaaaccaaggcttcggagaaggatgccaagcatcggaaataactgcttctcccaccccatccctaaggggctcccaggccctgaaatagggacttagctcttgggggtgggcctggaaggactgaaaggtgggattagagtcaggccagaaagagaacattcatccagagatcccagagttggggatctggcttggagtaagggagggtggcctctctgtggtggtgtgttggtaagttaagggcccaggtatttgtctcatgtgtgcaattttctgacctttgatggttgagaagggtttggacagaaaattgacatgaaaagatctggctcatggggcagagccctttccattagcgtggctgggtggccgtgggtgcttctagaggccaaagcctttgtgtttttcactggtggcaggaggaaaattgataaatcagaggtgctactgaggagttggtgcccctcattccagaatctcctacccccagaaaaggggtgctggaaggaggccccagtggactctttgtacccttcctactctcagagagaagtgggcaggaggggtcctcaaggaacaaagaagataaagcacaaatcgcagaacttgaatccaggctgctgctcatcatagtcctgttgctgtctgtcctatttatttatgtatgttgtaattaaatttgaaattttaaaa

SEQ ID NO: 31968 - DNA, 2866 bp, Homo sapiens
cgccaggacacactgttcgggcgcggctttccccgtccgcggagcggtcttgacactcgcggcggcagcatctacgctcgcagagccgccgatgcgtgtccagtgacccggacagcaaggcccgcgcgcggcgggggcggcggcagacgcctggtcaccgtgaccccgattttggatttaccgcttgggggctggggggatcctggatttaactggcgactgttttgggggacgccggacgccatgttgtggaaaataaccgataatgtcaagtacgaagaggactgcgaggatcgccacgacgggagcagcaatgggaatccgcgggtcccccacctctcctccgccgggcagcacctctacagccccgcgccacccctctcccacactggagtcgccgaatatcagccgccaccctactttccccctccctaccagcagctggcctactcccagtcggccgacccctactcgcatctgggggaagcgtacgccgccgccatcaaccccctgcaccagccggcgcccacaggcagccagcagcaggcctggcccggccgccagagccaggagggagcggggctgccctcgcaccacgggcgcccggccggcctactgccccacctctccgggctggaggcgggcgcggtgagcgcccgcagggatgcctaccgccgctccgacctgctgctgccccacgcacacgccctggatgccgcgggcctggccgagaacctggggctccacgacatgcctcaccagatggacgaggtgcagaatgtcgacgaccagcacctgttgctgcacgatcagacagtcattcgcaaaggtcccatttccatgaccaagaaccctctgaacctcccctgtcagaaggagctggtgggggccgtaatgaaccccactgaggtcttctgctcagtccctggaagattgtcgctcctcagctctacgtctaaatacaaagtgacagtggctgaagtacagaggcgactgtccccacctgaatgcttaaatgcctcgttactgggaggtgttctcagaagagccaaatcgaaaaatggaggccggtccttgcgggagaagttggacaagattgggttgaatcttccggccgggaggcggaaagccgctcatgtgactctcctgacatccttagtagaaggtgaagctgttcatttggctagggactttgcctatgtctgtgaagccgaatttcctagtaaaccagtggcagaatatttaaccagacctcatcttggaggacgaaatgagatggcagctaggaagaacatgctattggcggcccagcaactgtgtaaagaattcacagaacttctcagccaagaccggacaccccatgggaccagcaggctcgccccagtcttggagacgaacatacagaactgcttgtctcatttcagcctgattacccacgggtttggcagccaggccatctgtgccgcggtgtctgccctgcagaactacatcaaagaagccctgattgtcatagacaaatcctacatgaaccctggagaccagagtccagctgattctaacaaaaccctggagaaaatggagaaacacaggaaataaaattggaacgaagaaaggttaggagagtagggaaggaacaggactgcaaaaatccttctccaccgcacagactgggaacccctcctggcctgggggaagagtttgttacctaccttactatttaaagagccttcactggttctgcatcacccgcccctggacttcttagttgtttctctagcgctgagctatctcctaactttggacctattatcagaaggtgacaagtactggctctttattcattaagctttttttttttgaaccccattctttccttctctgaaagtggtgctataagttttagaatcttttaaatacattccctgggccaacagacccacacacttagccattgaaatgtcaaattgatgtgccctagatcaacagatcaacaataccttttttttcagtgttaaggtaatggttggtttttgtgtccgctaaatatttaccttgaaaaaaagaaaagtgtgtatctagcttcttcagagatcaagtcctctggtaggaggcaaaggttctatctgcttagcaactagttaataagtggtatctgacacactctaaaccccgtgttcaaacgggggccttctggttttaggaaacttgtagaaacgaagcctgctgattgatttttttctcctttttttttttttttttttttaactttgaaagttaactcttcaaatgggagactctttgaaatgacatgttcctttaaggtactgaagctttatttgcatatttatttcagatgtttcgagtaaacttgaaaagggtaggcacgaagcaatttgttgctgcttgtcacccccaagtccccgtggaggttctgtattttaagaaacagtgcgttgagtgtacagattttatttatgcgtaatttaatggggtctgtaaatactggtgcacttcttacgacttttttgagacatgggatccaattttaatattaacttttaatggtgatggggtaatctataacacatcataaggttttattcatatatatacagggtattaagaattaagaggatgctgggctctgttcttggcttggaagattctatttaattgaaactctctgttcagaaagcaataactttgtctcgttcctgttgggctgaaccctaaggtgagtgtgcagtacagtgtgtgtgggtgaaatggagatttggaattgaactctctgcctgtaaatgttccccaaataattgttgtgtgtatgatacgtgtataataaaagtattcttgttagaatctgaaa

SEQ ID NO: 31969 - DNA, 482 bp, Homo sapiens
cgagctcaggggcgccgggagcgcggagctcgggctacggactcgcgggagttcactgcgcctccgggccctggagggctgcccctgcccgcaggcccgggcgcttccgccaggaggcgacagcgccatgttcctccaggatcgccacgacgggagcagcaatgggaatccgcgggtcccccacctctcctccgccgggcagcacctctacagccccgcgccacccctctcccacactggagtcgccgaatatcagccgccaccctactttccccctccctaccagcagctggcctactcccagtcggccgacccctactcgcatctgggggaagcgtacgccgccgccatcaaccccctgcaccagccggcgcccacaggcagccagcagcaggcctggcccggccgccagagccaggagggagcggggctgccctcgcaccacgggcgcccggccggcctactgccccacctctccgggc

SEQ ID NO: 31970 - DNA, 1674 bp, Homo sapiens
ttttctggcccaagacccagggttcggacttggcgcctccaagcgcctcgggcttgggagcagcgcctagaccttcgccgccgggctttgagaactcgttcccccaggatcgccacgacgggagcagcaatgggaatccgcgggtcccccacctctcctccgccgggcagcacctctacagccccgcgccacccctctcccacactggagtcgccgaatatcagccgccaccctactttccccctccctaccagcagctggcctactcccagtcggccgacccctactcgcatctgggggaagcgtacgccgccgccatcaaccccctgcaccagccggcgcccacaggcagccagcagcaggcctggcccggccgccagagccaggagggagcggggctgccctcgcaccacgggcgcccggccggcctactgccccacctctccgggctggaggcgggcgcggtgagcgcccgcagggatgcctaccgccgctccgacctgctgctgccccacgcacacgccctggatgccgcgggcctggccgagaacctggggctccacgacatgcctcaccagatggacgaggtgcagaatgtcgacgaccagcacctgttgctgcacgatcagacagtcattcgcaaaggtcccatttccatgaccaagaaccctctgaacctcccctgtcagaaggagctggtgggggccgtaatgaaccccactgaggtcttctgctcagtccctggaagattgtcgctcctcagctctacgtctaaatacaaagtgacagtggctgaagtacagaggcgactgtccccacctgaatgcttaaatgcctcgttactgggaggtgttctcagaagagccaaatcgaaaaatggaggccggtccttgcgggagaagttggacaagattgggttgaatcttccggccgggaggcggaaagccgctcatgtgactctcctgacatccttagtagaaggtgaagctgttcatttggctagggactttgcctatgtctgtgaagccgaatttcctagtaaaccagtggcagaatatttaaccagacctcatcttggaggacgaaatgagatggcagctaggaagaacatgctattggcggcccagcaactgtgtaaagaattcacagaacttctcagccaagaccggacaccccatgggaccagcaggctcgccccagtcttggagacgaacatacagaactgcttgtctcatttcagcctgattacccacgggtttggcagccaggccatctgtgccgcggtgtctgccctgcagaactacatcaaagaagccctgattgtcatagacaaatcctacatgaaccctggagaccagagtccagctgattctaacaaaaccctggagaaaatggagaaacacaggaaataaaattggaacgaagaaaggttaggagagtagggaaggaacaggactgcaaaaatccttctccaccgcacagactgggaacccctcctggcctgggggaagagtttgttacctaccttactatttaaagagccttcactggttctgcatcacccgcccctggacttcttagttgtttctctagcgctgagctatctcctaactttggacctattatcagaaggtgacaagtactggctctttattcattaagcttttttttttt

SEQ ID NO: 31971 - DNA, 1424 bp, Homo sapiens
ggagcggcggtgaaggtcctgggtgaggtagggttggatggtgcttgccgcgtatcatggctgcctccggaaaactcagcacttgccgtctccctccgttgcccacgattcgagaaatcattaagttgttaagactgcaagcagcgaagcagctatcacagaatttcctcctggacttgaggctgacagataagattgtaaggaaagctggcaatctgacaaatgcttatgtttacgaagtgggccctgggccagggggaatcacaagatctattcttaatgccgacgtcgctgaacttctggtggttgaaaaggacactcgatttattcctggattacagatgctttctgatgcagcacctgggaaactgagaattgttcatggagatgtcttgacatttaaggtagaaaaggctttttcagaaagtcttaaaagaccctgggaagatgatcctccaaatgtacatattattggaaatctgccttttagtgtttcaactccactgattatcaagtggcttgaaaatatttcctgtagagatggaccttttgtttatggcagaactcagatgactttgacttttcaaaaggaagtggcagagagacttgcagccaatacaggaagcaaacagcgtagtcgcctctctgttatggctcagtacctctgcaatgttcgacacatctttacgattccaggacaagcttttgtccccaaaccagaggtggacgtgggcgtggtgcacttcactcccttgatacagcccaagatagagcagccattcaagctggtggaaaaagtggttcagaatgtatttcagttccgaaggaaatactgccatcgagggctcagaatgttattccctgaagcgcagcgcttggaaagcacgggcaggctgttagagttggcagacatagaccctactcttcggccccgccagctctccatctcacactttaagagcctctgtgatgtatacagaaaaatgtgtgatgaagacccacaactctttgcatataatttcagagaagaactcaagcgaagaaaaagcaaaaatgaagaaaaagaagaggatgacgcagagaattacagactctagctgctgcctgggggcgagcagcctaccagatgtcgatttgcactacgtggagcttcttatataggtactcttttgtctttacagaatgacgatacaaatgccaatgaccagatgtgacttattttccttttactatacagcttggcagagaaaataaatatcatcaaataagatacagtacaagctttcttttaatatatactgtatagatagttatgacatgtttagtataaacagcatctattacaatctatcttacaaaaatgaagtatctgcacattttgcccctaaaccacattaaaataacttaaatatgctttaaataaa

SEQ ID NO: 31972 - DNA, 3415 bp, Homo sapiens
gggaggagggggaagaagacgagggggaggagggcggtcgtccggggttaggttgagggggggcgtcggtccgttctgggcgggggatgactcacagcccatcccatctcccagacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttg

SEQ ID NO: 31973 - DNA, 3546 bp, Homo sapiens
gagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccatcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgctacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctatgttttttaatagaagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggatttgtgtgtgtgtgtgtgtgtgtgtgtgtttaaagcatttgataaggtttaaatgttttttatacagagatttttgttcattaaactcaatctgcatcatggtctaatttctcttggtttgaaacaaattgaaaactttgaaaccaaaaaattaagtcaatgacttgtttaaaactgacctgagcaacttgttatattac

SEQ ID NO: 31974 - DNA, 3562 bp, Homo sapiens
gacgtcatgttcgccgggcaggcgaggaaagaggacgccatgattggttggcgctggggcggcggacggtggaagggcctggcgagtctaggttttacgcctgtgctggactttctccttccatgtttccaggccgtggggggctacagagggcgagaagtcggctcagcggaaacctggatttggttctaagccgtggggttgagaaggggtgaccggaagtgatcgtgggactgaccggaagcgaggcctggaggggaaagagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccatcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgctacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctatgttttttaatagaagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggatttgtgtgtgtgtgtgtgtgtgtgtgtgtttaaagcatttgataaggtttaaatgttttttatacagagatttttgttcattaaactcaatctgcatcatggtctaa

SEQ ID NO: 31975 - DNA, 1862 bp, Homo sapiens
gactgaccggaagcgaggcctggaggggaaagagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagaaaccaatgatagctatcatatcatactgaagtaggagtgcggcgtttcgtgcc

SEQ ID NO: 31976 - DNA, 9292 bp, Homo sapiens
accgcgggttcggagcgcgaagccgccgctgggtcctcggcgcgccccgcgtctgcgcttgctgccgcgccccggtcggcgcgctgggagttccagccatgctcttctggcacacgcagcccgagcactacaaccagcacaactccggcagctacctgcgtgatgtgctcgctctgcccatcttcaagcaggaggaaccccagctgtcccccgagaacgaggcccgcctgccacccctgcaatatgtgttgtgtgctgccacgtccccagccgtgaagctgcatgaagagacgctgacctacctcaaccaaggtcagtcttatgaaatccgactactggagaatcggaagctgggagactttcaagatctgaacacaaaatatgtcaagagcatcatccgtgtggtcttccatgaccgccggctgcagtatacggagcaccagcagctggagggctggcggtggagtcggccaggggaccggatcctggacatcgatattccactgtctgttggtatcttggaccccagggccagcccgacccagctgaatgcagtcgagtttttgtgggaccctgcgaagagagcttctgcattcattcaggtacactgcatcagcacagaattcacccccaggaagcacgggggcgagaagggagtgccctttcgagtccagattgacacgtttaagcagaacgagaatggggagtacacggagcacctgcactcagccagctgccagatcaaggtgttcaagccgaagggagccgatcggaaacagaagactgaccgggagaagatggagaaaagaactgcccaagagaaggagaaataccagccgtcctatgaaaccaccatcctcacagagtgctctccatggcccgacgtggcctaccaggtgaacagcgccccgtccccaagctacaatggttctccaaacagctttggcctcggcgaaggcaacgcctctccgacccacccggtggaggccctgcccgtgggcagtgaccacctgctcccatcagcttcgatccaggatgcccagcagtggcttcaccgcaacaggttctcgcagttctgccggctctttgccagcttctcaggtgctgacttgctgaagatgtcccgagatgatttggtccagatctgtggtcccgcagatgggatccggctcttcaacgccatcaaaggccggaatgtgaggccaaagatgaccatttatgtctgtcaggagctggagcagaatcgagtgcccctgcagcagaagcgggacggcagtggagacagcaacctgtctgtgtaccacgccatcttcctggaagagctgaccaccttggagctgattgagaagatcgccaacctgtacagcatctccccccagcacatccaccgagtctaccggcagggccccacgggcatccatgtggtggtgagcaacgagatggtgcagaacttccaagatgaatcctgttttgtcctcagcacaattaaagctgagagcaatgatggctaccacatcatcctgaaatgtggactctgagcagcagtggacctcatacctgtctccagctcccagccctgtggatccccgtggatgtagacattgccccactgtaagctgtggcctcaccaggcaagctgaggccaggagggaccctgcccagtctgtgaaagctacagagcaccaaccagcagaagcctgtggacaccaagtacggtgtacagaaagccagtggctcctttctcccttcctcttggcctccagattttgaatggttccttgttcttttctattggtccaaccctgacgttctaaaagggcaaacagtggagacgtctgctctgaaatccctcatcccttagttggaagctgattgggtatcttggtgctgcctgtattggtcccttctgaccactctcctgcctccagagaaagctctgcttcaccctggaagctggtacctttacctcctcctctgggagttggctgcatggccagcactgccgacttgatgggagcagtttgccctcattctcctgtttcaggtttgcttcccttctcagtgaccctggtgagcatccgcctttcctgttcttggatgaattgatgggagtggggctattctgtgccttctacctctttcttctctacgttgtttctaaggatctgctgctgcggaacccaaagatgtgctcctgtctctgcactggcgcattggcatggtagatgccacaatgtatgtgcacggcctttctcagagacattagttctgaggccctttgtggggaggttagggggatggtaatagaaaaagactattttatttcctggcaatcacgggtaaggaggattaggaatgagtattccattcctaggtgtcatcagatgaccttgaccaccacaataccaggccctcttggatggacttatagaaagttagagaagaccttgttgaaccgctgctaaacttgccacaggagcgatgtgttttctctgagtgcccctcacttacatgtttatctttgtttgtagaggctatgtttaggatattttgcctgcatcagaatgggtgcatcatctttcttaatggcctaactatcgggaaatttgagtgtcagtaactgtggtagactcagaaattcgtctttgtcttgcctctggttcctgggatccagtgatctctactggcccagggcttcagctcttggttaatttaggttcatggggaaccctctgaccacctgaatgggatgtcatagcttctaaatggagcttctgtggaatgaagtgctagactgaaggactaccagaataaaacagggtctacaatggggagaacttgttttatagatgaggaaaccaaggctcagaggggcaaagtcacctgcatggtagcacatagtgatagggtagcgatataaatttatcatataaaccaggacatctcggaataaaaggggctctgttagtcattatgttgggtaatagccgtggcattcctacagaacagagtgaggacaggctcctgattcctcttccttctttagaggagaagcggggagtgggttaactaacagctttattgagatgtcattcacatgccattcagtttacccattgctagtgtccaattgtattcacagaaccaccatcaattcacagaattacagtcaacgttggtacattttcatcacccccagtaaaaccccgtacccttggtctgtcactcctgctttcctaactcctgcagtccaaggcagccatgaatctactttctatgtaagattaacctactctggacatttcatatatctggaatcatgtgatatctcttttgtgactggcttcttccactgaatgttttctagggccgtccaagttgaggatgtatcagtacttcattcttttgtattgctgaataatacttcattgtatagatagaccacatttgtttattgattcatcagttgatggacatttgtgtgtttttactttttggctactctgaatgatgctgctatgaacatatttctacaagattttgtgtggacatatgttttcatttcttttagcaatatacataggagtggaattgctaggtcttacagtaactccgtgttttaactttttgagaaactgccagactgttttctatagcagctgtaccattttacattcccaccagcaatgtatccaggtttcaatttgtctacatcctcatcaacacttgctattatctgtctttttgcttttagcatcctaatgagtatgaaatgctatcttgtggttttgatttgcattcccctgatggcaactgatgctgagtgtcttttcctgtgcttacgggccatgcgtatttctttggagaaaggtctatccaggtcctttgcctatttttaattgagttgtctttttttttttaagttttctgttttcctaaccactagactaccagggatgagccttctttttattattgagttgggtgagctatttgtatattctagacgccagtcttttatcaggtatatgactggtaaaaatgttctccccttctgtggattgttttcagtttcttgttggtgtcctttgagacacaaaactttttaactttgatgatttccaagatacgtattttttttctattgtcacttgtgcttttggtgccatatctagaaaaccattgcctaatccaaggtcaagaagattaatgcctgtgttttcttctaagaactatacttttagttctcacaatggtctttgatccatttcgagtatatttttatatatgatgtgatgtaggggtccagcttcattcttttgcttgtggatctccacttgtcccactgctgattattgagaaaaatatcctttctccacggaattgtcttggcatccttgctaaaggcctctgcttcttactggatcttctttcctgggacatggtgtcgttgggaagcttaccttttttttttttttacttagtctgtgtttggttccaccagttttatgctgcctttctactctgttcttgctgtctccctctttacctgagtcaacggtactgagtcctatctctctctgatgttccccagtcttccttggtgcatgttctagctccacacactagtccttggaggaaggttgagaccaatgatttcctgttatgagtcatgaggaaactgaatcacctagaagtggaataatgtgctcagggtcaccatagcccattagtggaaggaccaggactagacctttagtcttctgaggtccagccccttaggctgtctgtcatcactgtacccaagtgatgtcactaccaaggccaaatgatggtgggctaaattttaattctcaaaagtgtaggaggctaatattgtcttctaagttccaaaagaagatgtaataaaagtctgttaccttaagtgtgctattagtagagtcttccatttttctggcatgcccctggcatctgctcttcttaccttctcgtggttgtagttaaagcttatagcttatgaaagaatagaaaataataaataccaaaaaaaagtacacatggtaatttggtaccaaaatatctcagctgcctaatttagcagctcatcccttccacaggggtcagatgagctaaagctccaggttttatttttcatttgattgacatacagaaaagccatagcccttcccacagctgtccagggtctttcctgtgagtccggaggtgctggcctattgagcaggacagctcttcccagggcattcccaccaacctgtggcttctgaactgtagcttctttttacagtgaaccccagagggaaataagacagacacatgtgctcaggccaccatcttgaactggaagcccaaagctgagttccttactcttaggtcgtcacggtttttgcggggtatctgcaaggttgagataaaccctttcctgtttaccaggttgtcctttctggatgaagggacagaggctgttgaatggaggaataataggtttgctggaggaggggcatggtatgcctgtggaaaggacaggatggggtggggaggtcgaggctttgacttggggtcctaaacaaaggtcaggtgttgccctagtgacctcttgcccagacagcccagagccccttacacagagctattaacctagggaaggctttaccagcagtggactggagccagccagggtcacaagtttccaagtccagcattgcttcaggggctggcctgagtaactgaagatctgaaaatcattaacaagtcgatgaaataaacggaaaagcctcttaggctgttgtcagtggagcagagggagaaagtccctaggcgctcagagggggtgagaaagcagtggatgattgggcgggggtgggggattagatgttgacactgcctggggtgtaggaagaggaacagagaacccagagtcagggtcctagatcccagaccctcgctcagtatgagtctctttgcctctctgggtctctatctcctcctcttacaaatacaggcttggtgatctctgaagatggcaccaacctgccatgaaatgaatctgaggggttttcccatttttccctccatcaaaatcgtacaaaaagctggacgtggtggcccatgcctctaatcctagcattttgggaggccgaggtgggagaatcacttgacgccaagagttcgagaccagcctgggcatcgtagtgagactccatctctgtctttttgaaaataaaaaatctttgaaaattgcacaacaggcaggagacctttacgtgtgcccatcctggttgtacacagtgccaccagtgctcctgcagtgcaaggcggcatgcttcttgacatgggtcagattgtgtccatcgtgtctttgggaatcagccctagctcctaactgggctgactacttcctccgcaaacttatgggggctcccagatattccttgccagccaggggccagacacagtgcaggcacagtctgtgtcattggtgcacatgtgcgtgtttacatgtgtacctgggttccttcccttgcccatgaatttgccatgagcacagccagaagcagcctcagcttggcaaggtgtggagatgactgctgttcccttcgcatttggggaaaacaggctccctcggtagctcgatgatcctcttttgatcttgtgtgacctcctggagagtggatgaagctggtggccttagcttttctagacagtgtaagtggcactgggcaaggcccccagagcagggcaaggtctctagagcgggtctcccacatgactggcttcacacaggcacttccgctcgggttgcatgctctgtgtcatcttaccggtccagggttgcaggtaggaaatgtttgtaccctcttctgattgccacctccttcccatcgccccttagggacagggcttgagggccagtgaggcgctggtcaggcaccccaggcctccttgggacctgcccaggggcaccctgagagctcctgaaacccccacttagcttccagacctttctgcaaaagctcctcctggctttcctccctcccccaatctatgggtcacagctaacagatctgagggcaactgctgtgctagtggccagggctgcacctgccatccccggctctgccactttagggccttctagaggcagtgtccttaggaagtagctctgaggcatgggttttctgctcctgtgcagggcagctgatgggataaggtggggaaggacggtcagtgcttgggccccagctggccagcctggcgatggggaaaccaaaccatgtcccccagcgaagggccagagtgggaacctgtcctcatgcccttcgtcctgaggagccctgaggtgggcagcaggggccaggggaagttttcaggccttcatcaaagagaacaacatcctcagctccgcacccctcatcctgtatcagcacttaccggtgtgtgactgcccttgtcagctagcatacggtgggcccacctggcccactggctgtttatgccactgatttatgatagggaatattatctttgaacccaatgaagtgttttctcccccatcacaaaaaaaaaaattcttatttttagtagacatgtatttaccaaaaatatgtactcaattattgtattttggattttatcaatttaaaaattgtggaaatttgtttgctcttacgccaacataatattgattttgcctcttggctctgaaagcccaaaatatttaccgtctagcccgttacagaaaaagtctgctgactactgagccagacctccattacctccatccctgttggattatttaaagaaagcctcagacagtaagggcttttttaaaagaataaaatgacttggtttgcgcttggaagcaggggaagcattcagatgagcggtttctgcattaaccctgcctatcacgcatctcgtgtcctgtgtggctggcgagccccccttggaaggttctggtgcttcagctggctcctgcagagtccaccccgcctcgtggtgggaatgcagagccctttgctttccttcttgccgcctgcttcctgttcctggggacccgctgggcctttggtctgcatcccctggccaggtccctcagggttgatgcgtggagaaggactttgagcagtggtgggcagcagtggcctcctggccagctcacactcttgtcctgggaggggcagcctgatctcacctccacctagtaccttggggactgaggaccttttggcttctctggagcctgcaagcctcttcccatgtgtccagctgctcttcctgctacaaaggggactgctcacagtggcctcagcttggtggttttgaggggccgccccccggccctccataagggtatcctgggcctgagaattctgcatctgccattggaggatggacagcctcaaatggaaggagtcccacgggagatgggtccgaggtccggctgtggccatccagccccctgtggcttgtccagcctctgtgcacccctggtgtcttcactccaggggcagacagcagccactgcagttcctttcttcgtgagtaacagtagtgatagcagctggggctaacaggctaggctttgtgttctgcgcatttggtcagcttctcactcgatcctccctaaagcaatggggaggcccccactagcccagttttcaggaagtcaactgggaggttagatgggggccagggtcccacagctactgatggcccgagccaggttgagcttcctggtgtccagtccggatcccacttgcagatctcatgctctcagataggtgggacaagttcttttgtcacagtgctggctctgtcctgaggcctcattgctggctgggtgtgctctgctgggaaaagctttgcggggcttgcttggttaaccacagaagagaaggggactgtttggggtgcctctctgcagcctccccgtgctgggtggaagcacggttactgtgttctctaatgttcatgtatttaaaatgatttctttctaaagatgtaacctccacacctttctccagattgggtgactcttttctaaaggtggtgggagtatctgtcggggtggtgtggcccttggatgggtcaggtgggtgtgagaggtcctggggaggtgggcgttgagctcaaagttgtcctactgccatgtttttgtacctgaaataaagcatattttgcacttgttactgtaccatagtgcggacgagaagtctgtatgtgggatctgtgcttgggttagaatgcaaataaaactcacatttgtaagaaa

SEQ ID NO: 31977 - DNA, 913 bp, Homo sapiens
ctggagcagaatcgagtgcccctgcagcagaagcgggacggcagtggagacagcaacctgtctgatggtgcagaacttccaagatgaatcctgttttgtcctcagcacaattaaagctgagagcaatgatggctaccacatcatcctgaaatgtggactctgagcagcagtggacctcatacctgtctccagctcccagccctgtggatccccgtggatgtagacattgccccactgtaagctgtggcctcaccaggcaagctgaggccaggagggaccctgcccagtctgtgaaagctacagagcaccaaccagcagaagcctgtggacaccaagtacggtgtacagaaagccagtggctcctttctcccttcctcttggcctccagattttgaatggttccttgttcttttctattggtccaaccctgacgttctaaaagggcaaacagtggagacgtctgctctgaaatccctcatcccttagttggaagctgattgggtatcttggtgctgcctgtattggtcccttctgaccactctcctgcctccagagaaagctctgcttcaccctggaagctggtacctttacctcctcctctgggagttggctgcatggccagcactgccgacttgatgggagcagtttgccctcattctcctgtttcaggtttgcttcccttctcagtgaccctggtgagcatccgcctttcctgttcttggatgaattgatgggagtggggctattctgtgccttctacctctttcttctctacgttgtttctaaggatctgctgctgcggaacccaaagatgtgctcctgtctctgcactggcgcattggcatggtagatgccacaatgtatgtgcacggcctttctcagagacattagttctgaggccctttgtggggag

SEQ ID NO: 31978 - DNA, 1680 bp, Homo sapiens
cacggcagccctacactcggcctggaagaattgtttttcttctctggaaaggtgaacatttatagcatttatttcccaaatctgttaacatggcaaaatatgtcagtctcactgaagctaacgaagaactcaaggtcttaatggacgagaaccagaccagccgccccgtggccgttcacacctccaccgtgaacccgctcgggaagcagctcttgccgaaaacctttggacagtccagtgtcaacattgaccagcaagtggtaattggtatgcctcagagaccagcagcatcaaacatccctgtggtaggaagcccaaacccacccagcactcactttgcctctcagaaccagcattcctactcctcacctccttgggccgggcagcacaacaggaaaggagagaagaatggcatgggcctgtgccgtctttccatgaaggtctgggagacggtgcagaggaaagggaccacttcctgccaggaagtggtgggcgagctggtcgccaagttcagagctgccagcaaccacgcctcaccaaacgagtcagcttatgacgtgaaaaacataaaacggcgcacctacgatgccttaaacgtgctgatggccatgaatatcatctccagggagaaaaagaagatcaagtggattggtctgaccaccaactcggctcagaactgtcagaacttacgggtggaaagacagaagagacttgaaagaataaagcagaaacagtctgaacttcaacaacttattctacagcaaattgctttcaagaacctggtgctgagaaaccagtatgtggaggagcaggtcagccagcggccgctgcccaactcagtcatccacgtgcccttcatcatcatcagcagtagcaagaagaccgtcatcaactgcagcatctccgacgacaaatcagaatatctgtttaagtttaacagctcctttgaaatccacgatgacacagaagtgctgatgtggatgggcatgacttttgggctagagtccgggagctgctctgccgaagaccttaaaatggccagaaatttggtcccaaaggctctggagccgtacgtgacagaaatggctcagggaacttttggaggtgtgttcacgacggcaggttccaggtctaatggcacgtggctttctgccagtgacctgaccaacattgcgattgggatgctggccacaagctccggtggatctcagtacagtggctccagggtggagaccccagcagtcgaggaggaagaggaggaggacaacaacgatgacgacctcagtgagaatgacgaggatgactgacgtcctctcgccttaagattcagcttcaggaaaacatttagggaaaagaaactttttttttttttttaatgtgaggttttctgtttcttttttgcctactcccaagaagatattggtaagctatagaatttagatatgcacctctgataagcaaggattgtttcccgtatgattaagacgtgctgttgatgtgtgttttgataccagtgtgctgacacagaatctttatttactttttaggattttgtgttttcattttctatttttctttaaatgcagagttcattgttgccccttaacagtttttcctgagtttactgaagaaattgtacttcatccacatccatgaaaataaaatgctctccttttgtgc

SEQ ID NO: 31979 - DNA, 2690 bp, Homo sapiens
ttccgggttgggagaaaggtggcggcgctttcggagggaataaaatggaaggagaatcaagcagatttgaaatccacactccagtttctgacaagaaaaagaaaaagtgttctatacataaggaaagacctcagaaacattcccacgaaattttcagagactcctccctggtgaatgaacagtctcaaataactaggaggaaaaagaggaaaaaagatttccagcatctcatttcttctcctttgaaaaaatccagaatctgtgatgagactgcaaatgccacttccacactcaaaaagagaaaaaagagaagatatagtgctttggaggtggacgaggaagcaggtgttacagttgtccttgtggataaagaaaatattaacaacacaccaaagcattttagaaaggatgttgatgttgtttgtgttgatatgagcatagaacagaagttaccaagaaagcctaaaacagacaaatttcaggtacttgctaagtcacatgcacataaatcagaagccctgcacagtaaagttagggagaaaaagaataaaaagcatcagaggaaagctgcatcctgggagagccagcgggcaagggacaccctgcctcagtcagaatcccaccaggaggagtcctggctttctgtgggtccagggggtgaaattacagaactaccagcatctgctcataaaaacaagtctaagaaaaaaaagaaaaagtccagtaaccgggaatatgagacactggccatgcctgaaggatcgcaagcaggcagagaggccgggactgatatgcaggaatcccagcctactgtgggcttggatgatgaaactccacaactactaggacctactcacaaaaaaaagtctaagaaaaaaaagaagaaaaagtccaatcaccaggaatttgaggcattggccatgcctgaaggatcacaagtgggcagtgaggttggggctgatatgcaggaatcccggcctgctgtgggcctgcatggtgaaactgcaggaataccagcacctgcttataaaaacaagtctaagaaaaaaaagaaaaagtccaatcaccaggaatttgaggcagtggccatgcctgagagcctcgagagtgcataccctgaaggatcacaggtgggcagtgaggttgggactgtggaaggcagtacagctcttaaagggttcaaggaatccaacagtacaaagaagaagtctaagaaaaggaagcttacgtctgtcaaaagggcacgagtgtctggtgatgatttttcagtgcccagtaagaactctgagagcacactctttgattcagtagaaggtgatggcgccatgatggaagaaggtgtgaaatctaggccccgacaaaagaaaacccaggcctgtttggcaagcaagcacgtgcaagaggcgccaaggttagaacctgcaaatgaagaacacaatgtggaaacagctgaagattccgaaataagatacttatctgcagattcaggagatgccgatgattcagatgcggatttgggttctgccgtgaaacagcttcaggagttcattcctaacatcaaggacagggccaccagcacaatcaagcggatgtaccgggacgacttggaacggtttaaggaatttaaagcacaaggtgtcgctattaaatttggcaagttttctgtaaaggaaaataagcagttagagaaaaatgtggaagactttctagccctgacaggcattgagagtgcagacaagctgctgtacacggacagatatcctgaggaaaaatctgtgatcaccaacttaaaaaggagatactcgtttagattacacattggtaggaacattgcccggccctggaaacttatatactatcgagcaaagaagatgttcgatgtcaacaattacaaaggcaggtatagcgaaggagatactgagaagttaaagatgtaccattctctccttgggaatgactggaagacgattggtgagatggtggcccgaagtagcctctccgtggccctcaagttctcacagatcagcagtcaaagaaatcgtggtgcttggagtaagtctgaaacccggaaactaatcaaggctgtcgaagaagtgattctgaagaagatgtctccccaggagttaaaagaggtggattccaaactccaagaaaatcctgaaagttgcctatcaattgttcgggaaaaactctacaagggcatatcttgggtagaagtagaagctaaagtgcaaaccagaaattggatgcagtgtaaaagtaagtggacagaaattctaaccaagaggatgactaatggtcggcgtatctactatggcatgaatgccctgcgggccaaggtcagccttattgaaaggttgtatgaaataaatgtggaagatactaatgaaatagactgggaagatcttgctagtgccataggtgatgttcctccatcttacgttcaaactaaattttctaggctgaaagctgtctatgttccattttggcagaaaaagacttttccagagatcatcgactacctttatgagacgactctacctttgctgaaggaaaagttagaaaaaatgatggagaaaaaaggcactaaaatccagactcctgcagcacccaagcaagttttcccatttcgagacatcttttattatgaagacgatagtgaaggaggacatagaaaaagaaagcgaagg

SEQ ID NO: 31980 - DNA, 3052 bp, Homo sapiens
gggttgggagaaaggtggcggcgctttcggagggaataaaatggaaggagaatcaagcagatttgaaatccacactccagtttctgacaagaaaaagaaaaagtgttctatacataaggaaagacctcagaaacattcccacgaaattttcagagactcctccctggtgaatgaacagtctcaaataactaggaggaaaaagaggaaaaaagatttccagcatctcatttcttctcctttgaaaaaatccagaatctgtgatgagactgcaaatgccacttccacactcaaaaagagaaaaaagagaagatatagtgctttggaggtggacgaggaagcaggtgttacagttgtccttgtggataaagaaaatattaacaacacaccaaagcattttagaaaggatgttgatgttgtttgtgttgatatgagcatagaacagaagttaccaagaaagcctaaaacagacaaatttcaggtacttgctaagtcacatgcacataaatcagaagccctgcacagtaaagttagggagaaaaagaataaaaagcatcagaggaaagctgcatcctgggagagccagcgggcaagggacaccctgcctcagtcagaatcccaccaggaggagtcctggctttctgtgggtccagggggtgaaattacagaactaccagcatctgctcataaaaacaagtctaagaaaaaaaagaaaaagtccagtaaccgggaatatgagacactggccatgcctgaaggatcgcaagcaggcagagaggccgggactgatatgcaggaatcccagcctactgtgggcttggatgatgaaactccacaactactaggacctactcacaaaaaaaagtctaagaaaaaaaagaagaaaaagtccaatcaccaggaatttgaggcattggccatgcctgaaggatcacaagtgggcagtgaggttggggctgatatgcaggaatcccggcctgctgtgggcctgcatggtgaaactgcaggaataccagcacctgcttataaaaacaagtctaagaaaaaaaagaaaaagtccaatcaccaggaatttgaggcagtggccatgcctgagagcctcgagagtgcataccctgaaggatcacaggtgggcagtgaggttgggactgtggaaggcagtacagctcttaaagggttcaaggaatccaacagtacaaagaagaagtctaagaaaaggaagcttacgtctgtcaaaagggcacgagtgtctggtgatgatttttcagtgcccagtaagaactctgagagcacactctttgattcagtagaaggtgatggcgccatgatggaagaaggtgtgaaatctaggccccgacaaaagaaaacccaggcctgtttggcaagcaagcacgtgcaagaggcgccaaggttagaacctgcaaatgaagaacacaatgtggaaacagctgaagattccgaaataagatacttatctgcagattcaggagatgccgatgattcagatgcggatttgggttctgccgtgaaacagcttcaggagttcattcctaacatcaaggacagggccaccagcacaatcaagcggatgtaccgggacgacttggaacggtttaaggaatttaaagcacaaggtgtcgctattaaatttggcaagttttctgtaaaggaaaataagcagttagagaaaaatgtggaagactttctagccctgacaggcattgagagtgcagacaagctgctgtacacggacagatatcctgaggaaaaatctgtgatcaccaacttaaaaaggagatactcgtttagattacacattggtaggaacattgcccggccctggaaacttatatactatcgagcaaagaagatgttcgatgtcaacaattacaaaggcaggtatagcgaaggagatactgagaagttaaagatgtaccattctctccttgggaatgactggaagacgattggtgagatggtggcccgaagtagcctctccgtggccctcaagttctcacagatcagcagtcaaagaaatcgtggtgcttggagtaagtctgaaacccggaaactaatcaaggctgtcgaagaagtgattctgaagaagatgtctccccaggagttaaaagaggtggattccaaactccaagaaaatcctgaaagttgcctatcaattgttcgggaaaaactctacaagggcatatcttgggtagaagtagaagctaaagtgcaaaccagaaattggatgcagtgtaaaagtaagtggacagaaattctaaccaagaggatgactaatggtcggcgtatctactatggcatgaatgccctgcgggccaaggtcagccttattgaaaggttgtatgaaataaatgtggaagatactaatgaaatagactgggaagatcttgctagtgccataggtgatgttcctccatcttacgttcaaactaaattttctaggctgaaagctgtctatgttccattttggcagaaaaagacttttccagagatcatcgactacctttatgagacgactctacctttgctgaaggaaaagttagaaaaaatgatggagaaaaaaggcactaaaatccagactcctgcagcacccaagcaagttttcccatttcgagacatcttttattatgaagacgatagtgaaggagaggacatagaaaaagaaagcgaaggccaggcgccatgcatggctcacgcctgtaattccagtactttgggaggccaaggccggtggatcatctgaggtcaggagttcgagaccggcctgaccaacatggtgaagacctgtcactattaaaaatgcaaaaattagccgggtgtggtagtgcacacctgtaatttcaactacttgggaggctgaggcaggagaattgcttgaacccaggaggtggaggttgcagtgagccaagatcgcaccaccgcatgagagagagagattactatttcttgtccctttttctcagtttgattatatttatatacatatgtcagtaaatctgttttcagtattgatgtttaataaagaatgtacaatggc

SEQ ID NO: 31981 - DNA, 4879 bp, Homo sapiens
agaattgggggcggggctttgtggaacttgggggacccagcgaaatggaagaagttaggtgtccagagcacgggactttctgctttcttaagaccggcgtccgcgatggcccgaataaaggaaagagcttctacgtgtgccgggcagacacgtgcagcttcgtgcgggccaccgacattcctgtttcccattgcttattgcatgaggactttgtggtagagcttcagggtttgcttctgccacaggacaagaaagaatacagattgttcttccgatgcattagaagtaaggcagaggggaaacgctggtgtggaagtattccatggcaggatcctgattccaaagaacattctgtatccaataagtctcagcatgcatctgagacatttcatcattcttccaactggctgagaaatccattcaaggtacttgacaagaatcaagaaccagctctctggaaacagctcatcaaaggtgaaggtgaggaaaagaaggctgataagaagcaaagagaaaagggagatcagcttttcgatcaaaagaaagaacagaagcctgaaatgatggagaaagacctctcatctggcctggtaccaaagaaaaaacaatctgtagttcaagagaagaagcaagaagagggagcagagattcagtgtgaggcagagactggaggcacacacaaaagagacttttctgaaattaaatctcaacagtgccaaggtaatgagcttacaagaccatctgcatcttctcaggagaaatcaagtggtaagagtcaagatgtccaaagagaatcagaacctctgagagaaaaggttacccagcttttgcctcaaaatgttcacagtcacaactcaataagcaagccccagaaagggggacccctcaacaaggagtacacgaactgggaggctaaagaaacaaaggcaaaggatggccctagcatacaggccacccagaaaagcctgcctcaggggcatttccaagagcggccggagacccacagtgtgcctgctcctggaggaccagcggctcaggctgcaccagcagcaccagggctttccctgggtgagggccgtgaagctgccacaagcagtgacgacgaggaggaagatgatgttgtttttgtttcctctaagcctgggagccccctactctttgactcgactctggacttagagacgaaggaaaacctccaattccctgatcgaagtgtgcaaagaaaggtgtctcctgcctcaggtgtttccaagaaggtagaaccctcagacccagtagcccggcgtgtctaccttacaacacaactgaaacaaaagaagagcacactggcatcagtgaacatccaggctcttccagacaagggtcagaagttgatcaaacaaatccaggagctggaggaagtactcagtggtcttaccctttccccagagcaaggaactaatgagaagagtaacagtcaagtaccacagcagagtcacttcaccaaaactaccactggccctccccacctggtgcctccccaaccccttcctcgtcgtggtacccaacctgtgggttctctagaactaaagtctgcctgccaggtgactgctggaggatccagtcagtgctatcgaggccatacaaaccaagatcacgttcatgcagtgtggaaaatcacaagtgaagccatcggtcaactgcatcgctcacttgagtcatgtcctggtgagacggttgtggcagaagatcccgccgggctgaaggtccctttgctactacaccagaagcaggcattggcttggttactatggcgagaaagtcagaagccacaaggaggaattctggcagatgatatgggcttaggaaaaaccctgacaatgattgcgctcatcctgacccagaagaatcaagagaaaaaggaagaaaaggagaaaagcacagctttgacgtggctctccaaagatgactcttgtgactttacttcccatggaacactaatcatctgtcctgcctccctgatccatcattggaaaaatgaggtggagaaacgggtgaacagcaacaaactaagagtctatctctaccatgggccaaaccgggattcacgtgccagagtcctctctacatatgacatcgtgatcactacctatagcctcgtggccaaggagattcccacaaacaagcaagaggcagagatcccaggtgcaaacctcaatgtggagggcacctcaacacctttgcttcgaatagcctgggctcgaatcatattggatgaagctcacaatgttaagaatccccgagtgcagacttccatagctgtgtgtaagctacaagcctgtgcccgttgggctgtcactggaacccccattcaaaacaacttattggatatgtattcgctgctgaagtttctccgttgctctccatttgatgagttcaatctgtggaggagtcaggttgacaatggctcaaagaaaggaggagaacggttaagtattttaaccaagagccttttgctgaggagaacaaaagaccagctggactctactggcagacctttggtgatactgccccagcgtaaatttcagttgcaccatttaaagctttctgaagatgaagagactgtttacaatgtgttttttgcaagatcaaggtcagctctgcaatcctatctaaaaagacatgaaagtagaggcaaccaatctggaagaagccctaataatccattcagtagagtggcactggagtttgggtctgaggagcctagacactcggaggcagcagactcaccgagatccagcaccgtccacatactgtcccagttgctgagactccgccagtgttgctgtcatctttctttactgaagtcggccctggatccaatggaactgaagggtgaaggtcttgtcctttccctggaagaacagctcagtgctttgaccttgtcagaactccgtgactcagagccatcttccactgtttcccttaacggcaccttcttcaagatggagctttttgaaggcatgcgagagagcaccaagatttcatctctgttggcagaattggaggcaattcaaagaaattcagcatcccaaaagagtgtcattgtctctcagtggaccaacatgctgaaagttgtagcattgcacctgaagaagcatggactgacttatgccaccatcgatggctctgtcaatcccaagcagagaatggacttggtagaggcatttaaccactccagaggccctcaggtaatgctaatctctctcttggccggaggtgttggtctaaacctgactggaggaaatcacctctttcttttggacatgcactggaatccatcacttgaagatcaagcttgtgaccgaatttaccgagtagggcagcagaaagatgttgtcatacacagatttgtttgtgagggaacagtagaagaaaagatcttacagctccaagaaaaaaagaaagatttggccaaacaagttctatcagggtctggagaatctgtcaccaagctcaccttggctgacctcagagtcctttttggcatctaacctcctgtggataagggctcagaatagcaccattgctggtttgtattaggatctgggaataacaacctaaccatgagccttgaactctgttctttgcatttcaatttcaccgtcaagcctttcaccttcctcaaaatgaggcataatcttatccccagaattgaggaggggttgtgttaaccaattagttaaccaattatgttaataatttatttaatgagtggtatggaaaccaattgatttttttagataaaagaatatgttttagagttggatgattttggaaaacaactctggcagaattgtatataagcttcagtaaagttcaaaaagcgggccaggtgtggtggctcatgcctgtaatcccgacactttgggaggccaaggcaggaggatggcttgaagccagtagttcaagaccagcctgggcaacatagtaagaccccatctctatgaagaataaaaaaatgagctaggcgtggtagtgcacacctgtagtcctagctacttgggaggctgaggcaggaggatcccttgagtccaggaggttgaggctgcagtgagctgtgattgtgccactgttttccagcctgggcaatacagtgagaccctgtctcaaaaaaaggaaaaaaaagctcaaaaagttctgtgttgcctttctcttcttagctgatgatgggagaaccagttactaccttctctaacacaggctccatcctatctcttcatctcttcttgccagtgatgttgcacctgtaaccatctttttatgggtggagcagagagtcaatccctgcagccaccctgcagccagccatctctgcagttctctcagtgcaggcagttcttcctctcaggctgaagatcaaggagatgctttgtacatgaacagatgctgagtatctgttatcattgtattgtttagtgtcagtgtatcatttagtatttgtatcactgtaccatttagtgttgtatatcactcagtcatttaatattggttatcaccatacagtttaatatttgtatcatttggttcattgtatcgtttagtatttctattataacatttctatttgtagtatttgtataatatttgtgtcatttttaatagtatttgtatttttacaaatttgcagtatttgtagcatttagtatcattgtttcatttagtatttggtacaatctaataaatactaatccagtccaatactaatccaatccaatactaataatactattggtacaatccaatactaataatactattggtacaatccaatactaataatactaacagtagtattgatacaatctaataaataatgtgtttgacagtgtagcagaaa

SEQ ID NO: 31982 - DNA, 639 bp, Homo sapiens
aacatgctgaaagttgtagcattgcacctgaagaagcatggactgacttatgccaccatcgatggctctgtcaatcccaagcagagaatggacttggtagaggcatttaaccactccagaggccctcaggtaatgctaatctctctcttggccggaggtgttggtctaaacctgactggaggaaatcacctctttcttttggacatgcactggaatccatcacttgaagatcaagcttgtgaccgaatttaccgagtagggcagcagaaagatgttgtcatacacagatttgtttgtgagggaacagtagaagaaaagatcttacagctccaagaaaaaaagaaagatttggccaaacaagttctatcagggtctggagaatctgtcaccaagctcaccttggctgacctcagagtcctttttggcatctaacctcctgtggataagggctcagaatagcaccattgctgctgatgatgggagaaccagttactaccttctctaacacaggctccatcctatctcttcatctcttcttgccagtgatgttgcacctgtaaccatctttttatgggtggagcagagagtcaatccctgcagccaccctgcagccagccatctctgcagttctctcagtgc

SEQ ID NO: 31983 - DNA, 3039 bp, Homo sapiens
aggggggacgcggcccggctggctggctctggcggcggctgggctggggccgcggtggcggcagccgcggcggcgggcggcggttgctcgtgcgcggcggcggcggcgggtcccgcgggcggcggggcgctgacggccgggggcgcggcggctgcggcgggccgggcggcgggcggcgagcgggggaagatggcggagctggggaagaagtactgcgtgtactgcctggccgaggtgagcccgctgcgcttccgctgcaccgagtgccaggacatcgagctgtgccccgagtgcttctcggccggcgccgagatcggccaccaccgccgctaccacggctaccagctggtggacggcgggcgcttcacgctctgggggcccgaggccgagggcggctggaccagtcgcgaggagcagctgctgctggacgccatcgagcagttcggcttcggaaactgggaagatatggctgcccacgttggtgcttcccggactccccaagaggtgatggagcattacgtgagcatgtacatccacgggaacctggggaaggcctgcatccccgacaccatccccaaccgcgtgacagaccacacctgtcccagcggaggccccctctcacccagcctcaccaccccgctgcccccgctggacatctctgtggctgagcagcagcagctgggctacatgccgctgcgggatgattacgagatcgagtatgaccaggatgccgagacgctcatcagcgggctctctgtcaactatgatgacgacgacgtggagatcgagctgaagcgcgcccacgtggacatgtacgtgcggaagctgaaagagagacagcggcggaagaacatcgcccgtgactacaatctggtgccagccttcctggggaaggacaagaaggagaaggaaaaggcgctgaagcgcaagatcaccaaggaggagaaggagctgcgcctgaagctgaggccgctgtaccagttcatgtcatgcaaggagtttgatgacctttttgaaaacatgcacaaagaaaaaatgctccgggccaagatccgagaactgcagcggtaccggcgaaacgggatcaccaagatggaagagtcggcagagtacgaggcagcgcggcataaacgggagaagaggaaggagaacaaaaacctagccggctccaaacggggaaaggaggacggcaaagacagcgagttcgccgccattgagaaccttccaggcttcgagctcctgtcagatcgcgagaaggtgctctgcagctctttaaacttgagtccagcccgctacgtgactgtgaagactattataattaaagaccacctccagaagcggcaaggaatcccctccaaaagccgccttcctagctacctggacaaagtcctaaagaaaaggattttgaatttcctcacagaaagcggctggatctccagggacgcgtcttgaagctgagacgctttgaaagccagggtgatgctcagacagtgtgccagccaaaatgacttgggggaggggagccgcttccccactgttgctcttttttaaacaaattgagttcctttttttaagatagaaattcttttcatggtcctctgaaagaagcaatagtaacaatcttatattggatcatgggggaagcaaatgtgtgtattttaagtgagttcctgcgagtcatacactgcgatgatgctccgcctttacccgttcagttgggagcttattgtgagattggatcatttccttttgagtgttcttctctttggtacaaaagctattgtgggtgacaggagcagtgttttcctgctggacccgcaagccaccagctatttcctggtgacacaagctcttctcaggcggggctgcctgcaggctcccgttttctgagcccacgctgcccacagctgaccccagcgcagccccgggcacgcggcactttacatgggggcagcttgggcccagactcctccgctgtgtagcagatgaggaaaatcaggccagaggacaacaggctggcgttttgttgggaactgaagaggaatctgttgaacacagcgaccagatgaccttccatttcaccggcggcagcagtttcagcgtgcagttcccaaaccccaaagctgaccctgcgccccatttgaatacggccagagcctgctggttcactttgggtagagccgtgcctcttgggcaggctcccatagtgaccacgtccccacgaatgggaaagcacgttagtgggagggacgtaggacacgtgtggaccgccaggccctctcagtccattttccggggctgctcggtgctgctgttaagacgtgagtgcatttcacttggaagaacccattgtacaaagttcaaggctaagagttctgaattctggcgtcagcttcctcaggattttcttcagttgcaagtacctttccactgaaaatatgagcatgcccgcctggctagtaggcatctgtaagagtgtcgccaggcccgcgccagctgaggcctcagactagccaggcaagagccgtctgaccagttggctggcggtggttctggtggagcacgagggagcccgggtggtgccctgagcctcgagctgctctctgtcactgtcttgaatcagactcagaaatggcttcttcccagccctgcctacaagtttttctctggggtcctctttcaaggatgtccacggtaccttcctcctgaaacttgaggaagtcttttgtcttccagctgctcagggttctctggtccaagaccctgctttaaagagagtctttggcgtgctcagactccagcgctccgttcttcaaggaggttgacttgcctctcgggccccgtaggtaccaagagactgtttacctcccagaatgtttgggcttgaagttacattaaagtgaagttatttgaaagaaagaaaacctcatcatttctaaggatgacttaattactgtgccttttcctttctttttacacatcctactgtcccttagggtaaaattttcagcattaaataaaacatttcaaatatattgt

SEQ ID NO: 31984 - DNA, 558 bp, Homo sapiens
atccgacagctgcccatggcctgcatcaccacctgcttcttgagtgcctggaagcgtcgccactccttctccaccctggtgagcttctcctggcactgccgcttcaactggcccagctcctggtggtaccactgcaggtcgtctgcctgctgcttcttcagctcctccagcatgcccagatggcgcaggaagatatggctgcccacgttggtgcttcccggactccccaagaggtgatggagcattacgtgagcatgtacatccacgggaacctggggaaggcctgcatccccgacaccatccccaaccgcgtgacagaccacacctgtcccagcggaggccccctctcacccagcctcaccaccccgctgcccccgctggacatctctgtggctgagcagcagcagctgggctacatgccgctgcgggatgattacgagatcgagtatgaccaggatgccgagacgctcatcagcgggctctctgtcaactatgatgacgacgacgtggagatcgagctgaagcgcgcccacgtggacatgtacgtgcggaagctga

SEQ ID NO: 31985 - DNA, 544 bp, Homo sapiens
taaccgtggaaggtgctaaaaatgaaggcctgctcccttgaagagccacaggcccatcttctgcagtcactgcctaggaaagggccacgccagcccccccggcgcatgaaggccaggatgggtgtgcggccaggacaagcgtcacagaggaagatatggctgcccacgttggtgcttcccggactccccaagaggtgatggagcattacgtgagcatgtacatccacgggaacctggggaaggcctgcatccccgacaccatccccaaccgcgtgacagaccacacctgtcccagcggaggccccctctcacccagcctcaccaccccgctgcccccgctggacatctctgtggctgagcagcagcagctgggctacatgccgctgcgggatgattacgagatcgagtatgaccaggatgccgagacgctcatcagcgggctctctgtcaactatgatgacgacgacgtggagatcgagctgaagcgcgcccacgtggacatgtacgtgcggaagctgaaagagagacagcggcggaagaacat

SEQ ID NO: 31986 - DNA, 1343 bp, Homo sapiens
gcggcggctgcggcgggccgggcggcgggcggcgagcgggggaagatggcggagctggggaagaagtactgcgtgtactgcctggccgaggaagatatggctgcccacgttggtgcttcccggactccccaagaggtgatggagcattacgtgagcatgtacatccacgggaacctggggaaggcctgcatccccgacaccatccccaaccgcgtgacagaccacacctgtcccagcggaggccccctctcacccagcctcaccaccccgctgcccccgctggacatctctgtggctgagcagcagcagctgggctacatgccgctgcgggatgattacgagatcgagtatgaccaggatgccgagacgctcatcagcgggctctctgtcaactatgatgacgacgacgtggagatcgagctgaagcgcgcccacgtggacatgtacgtgcggaagctgaaagagagacagcggcggaagaacatcgcccgtgactacaatctggtgccagccttcctggggaaggacaagaaggagaaggaaaaggcgctgaagcgcaagatcaccaaggaggagaaggagctgcgcctgaagctgaggccgctgtaccagttcatgtcatgcaaggagtttgatgacctttttgaaaacatgcacaaagaaaaaatgctccgggccaagatccgagaactgcagcggtaccggcgaaacgggatcaccaagatggaagagtcggcagagtacgaggcagcgcggcataaacgggagaagaggaaggagaacaaaaacctagccggctccaaacggggaaaggaggacggcaaagacagcgagttcgccgccattgagaaccttccaggcttcgagctcctgtcagatcgcgagaaggtgctctgcagctctttaaacttgagtccagcccgctacgtgactgtgaagactattataattaaagaccacctccagaagcggcaaggaatcccctccaaaagccgccttcctagctacctggacaaagtcctaaagaaaaggattttgaatttcctcacagaaagcggctggatctccagggacgcgtcttgaagctgagacgctttgaaagccagggtgatgctcagacagtgtgccagccaaaatgacttgggggaggggagccgcttccccactgttgctcttttttaaacaaattgagttcctttttttaagatagaaattcttttcatggtcctctgaaagaagcaatagtaacaatcttatattggatcatgggggaagcaaatgtgtgtattttaagtgagttcctgcgagtcatacactgcgatgatgctccgcctttacccgtt

SEQ ID NO: 31987 - DNA, 3818 bp, Homo sapiens
ttctcaaagaggcccacagttgagttttggcactgccttctgtagtcagagtcctggagattcctgggccccaggtggcggggggaagggtccagcacctcggctccaggcatgtgtgccagaggaagccccagctgtgggatcccatccgttcctggagcccagaacacttctctcccagacgccagctcatagtcatcagcctggatggggtggcggtccctctggtttcagctgggcctctggcagtgctgcaggcagcgctgcagtgctggttccacacccaggcgggcagaggcaggtgggggctgggtggctgagaggcggtggccagggaatgagtgcgcactttgggcagttactttctgaagtggctttagcggttgactttgaggaagaggcctctcggcagaaggaaaagattgagggagttatacagtttcctcccattaaaccttgtatttatgggttaccctcttgtaggaatgatgaatgctttcagccagtggcagactcccagccagctgcttaaccgtggaaggtgctaaaaatgaaggcctgctcccttgaagagccacaggcccatcttctgcagtcactgcctaggaaagggccacgccagcccccccggcgcatgaaggccaggatgggtgtgcggccaggacaagcgtcacagaggtgtcctggcccttgcttttccagcgggtggcaacatggtagaactgggtcccctcctgcagtgccgtggacttggcctggtctcacaccctggcacaagcccgttttctagtctgaatgaggcgagttcaggcattccttggcctgccctgctgtctcctgggacattcagacagcccctgagtgcagggtttatggcagtaccaggtgggctcctctggtcgcaggtggggaatgagaacaaagtccaaacctcagccaggggttctggcctcagctctgccaccagctcaccccaagaccttgtgccagcttgtgcctctctgggtcttcactttctcatgtacagaatcagcatgtgttgttgcttcaacattgtcatctctcccctgagcccagctcataagacagtgtgtgactgaatgcctttggggagggtgggtaacggtgctgtaggaagtactctaggtcagcctttgtaaaaacgtgaagagaatctgtgcggaacccaaatctggcaccctgatggtggaactaacttctgccctttgtcatcgtaggaagatatggctgcccacgttggtgcttcccggactccccaagaggtgatggagcattacgtgagcatgtacatccacgggaacctggggaaggcctgcatccccgacaccatccccaaccgcgtgacagaccacacctgtcccagcggaggccccctctcacccagcctcaccaccccgctgcccccgctggacatctctgtggctgagcagcagcagctgggctacatgccgctgcgggatgattacgagatcgagtatgaccaggatgccgagacgctcatcagcgggctctctgtcaactatgatgacgacgacgtggagatcgagctgaagcgcgcccacgtggacatgtacgtgcggaagctgaaagagagacagcggcggaagaacatcgcccgtgactacaatctggtgccagccttcctggggaaggacaagaaggagaaggaaaaggcgctgaagcgcaagatcaccaaggaggagaaggagctgcgcctgaagctgaggccgctgtaccagttcatgtcatgcaaggagtttgatgacctttttgaaaacatgcacaaagaaaaaatgctccgggccaagatccgagaactgcagcggtaccggcgaaacgggatcaccaagatggaagagtcggcagagtacgaggcagcgcggcataaacgggagaagaggaaggagaacaaaaacctagccggctccaaacggggaaaggaggacggcaaagacagcgagttcgccgccattgagaaccttccaggcttcgagctcctgtcagatcgcgagaaggtgctctgcagctctttaaacttgagtccagcccgctacgtgactgtgaagactattataattaaagaccacctccagaagcggcaaggaatcccctccaaaagccgccttcctagctacctggacaaagtcctaaagaaaaggattttgaatttcctcacagaaagcggctggatctccagggacgcgtcttgaagctgagacgctttgaaagccagggtgatgctcagacagtgtgccagccaaaatgacttgggggaggggagccgcttccccactgttgctcttttttaaacaaattgagttcctttttttaagatagaaattcttttcatggtcctctgaaagaagcaatagtaacaatcttatattggatcatgggggaagcaaatgtgtgtattttaagtgagttcctgcgagtcatacactgcgatgatgctccgcctttacccgttcagttgggagcttattgtgagattggatcatttccttttgagtgttcttctctttggtacaaaagctattgtgggtgacaggagcagtgttttcctgctggacccgcaagccaccagctatttcctggtgacacaagctcttctcaggcggggctgcctgcaggctcccgttttctgagcccacgctgcccacagctgaccccagcgcagccccgggcacgcggcactttacatgggggcagcttgggcccagactcctccgctgtgtagcagatgaggaaaatcaggccagaggacaacaggctggcgttttgttgggaactgaagaggaatctgttgaacacagcgaccagatgaccttccatttcaccggcggcagcagtttcagcgtgcagttcccaaaccccaaagctgaccctgcgccccatttgaatacggccagagcctgctggttcactttgggtagagccgtgcctcttgggcaggctcccatagtgaccacgtccccacgaatgggaaagcacgttagtgggagggacgtaggacacgtgtggaccgccaggccctctcagtccattttccggggctgctcggtgctgctgttaagacgtgagtgcatttcacttggaagaacccattgtacaaagttcaaggctaagagttctgaattctggcgtcagcttcctcaggattttcttcagttgcaagtacctttccactgaaaatatgagcatgcccgcctggctagtaggcatctgtaagagtgtcgccaggcccgcgccagctgaggcctcagactagccaggcaagagccgtctgaccagttggctggcggtggttctggtggagcacgagggagcccgggtggtgccctgagcctcgagctgctctctgtcactgtcttgaatcagactcagaaatggcttcttcccagccctgcctacaagtttttctctggggtcctctttcaaggatgtccacggtaccttcctcctgaaacttgaggaagtcttttgtcttccagctgctcagggttctctggtccaagaccctgctttaaagagagtctttggcgtgctcagactccagcgctccgttcttcaaggaggttgacttgcctctcgggccccgtaggtaccaagagactgtttacctcccagaatgtttgggcttgaagttacattaaagtgaagttatttgaaagaaagaaaacctcatcatttctaaggatgacttaattactgtgccttttcctttctttttacacatcctactgtcccttagggtaaaattttcagcattaaataaaacatttcaaatatattgt

SEQ ID NO: 31988 - DNA, 2355 bp, Homo sapiens
cttccggttctgtacccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggccgtggcccttcccctgaggtcttttggcctagctctgtacaaccaggacacaggaagccctgctgggctagcctgaggcctagtctctgcttggtccccgagatggggttggaggggacttcgtttctgggtcttcctcttcccctctttaccatcccccactccctaatcccctacccctgtctccccttcaaggacttctcccttgtggttttgtaaagtgcaaacttaagaataaagtgactgctgtggtttttcaaaaaaagcatccagtctttgaatgtctgttacagtggggaggaaggaaccagtgtgggtggtaaggtttgtggggggtatgcttggtggctctcagcccatggccactaaccc

SEQ ID NO: 31989 - DNA, 2554 bp, Homo sapiens
gtacccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggtgagcgttagcaggatgcacagtcccgggggtggccttggaggctgtggccacggctagtcacctttcaggggttttacaacaggctttccaatcctggctggcctctaaatcacctggagagcctcgaaaaaaacagcagtggccagtccaccgggtatgtcccaaacaaattctgattccacagagtggggctcaggcatctgtgactgaccgattgatttgatttgtttttgttttgtttttttttgagagggagtctcgcactgtcacccaggctggagtgcagtggcatgatctcggctcactgcaagctccgcctcccaggttcatgccattctcctgcctcagcctcctgagtagctgatactacaggcacccaccaccacgcccagctaatttttttgtatttttagtagagacggggtttcaccgtgttagccaggatggtctcgatctcctgacctcgtgatccacccgcctcggcctcccaaagtgccgggattacaggcgtgagccactgcgcctggcctagtttggttttttaattatggtaaaggcataatataaaatgtatctccatgggaggctgaggcaggagaatcagttgaacctgggaggcggaggttgcagtgagctgagactgcaccattgcattccagcctgggcaacaagagtgaaactgcatctcaaaaaaaaaaagaaaaaaaatttacgcttcttaaccatttttaagtgtacagtttagtagtgttacccatattcacattgttgtgtgatttattttttgtcttttcatgcttcttttctttttatccccaaagttttgttattaaaaatttgatacacacagaaaatctgaaagaatcatacaataaacatcagtatattctccaccta

SEQ ID NO: 31990 - DNA, 873 bp, Homo sapiens
aattaggacaagccgaagcggacgagcccttcgtttcttccggttctgtacccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctcccc

SEQ ID NO: 31991 - DNA, 1617 bp, Homo sapiens
accatctatgctccgagcggggtagagagcccttacgaacgcttgggccttccggaagttttccacctagggctgtctcggtatttttaaattcttgcactcgagtcactatttaagctcctccaggaatgggtgcagcttccctttgtgccttcggccttcttgtcacctttgccacagcctcccccagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctc

SEQ ID NO: 31992 - DNA, 1467 bp, Homo sapiens
agtgcggttccttctaaaaaggagaggcgggagagtcagggtggagaaggcggctccaaccagattttgcgtccacaaagccaaaagcttctaggcctggcatgtacggcgggtttgtgcccgaggagcacagctggtctacacgggcccgccccgtagacaccctactcctcgactttccccttttcccagtccgagtttgacgtcggtctcctggataccaggcagccaatcgcctcgttgcgaagggaccagcgcagccaatcaggcgtcgttgctacctgaacaagatcactcaaggtgaaggataatctactaataccagcactttgaatgaaaatttgtttctctgccacaaactgaacatcttttttttttttttttttttttggtgggggagttgaaacctaattttgtggcgtagcagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaaatcttttgtagatggcttgaattttagcttaaataacatgcagtattctaaccagcaattccagcctgttatggctaactaa

SEQ ID NO: 31993 - DNA, 2229 bp, Homo sapiens
gaagctctggcccggcgtgtagcgggcgcactacggggacgctgggccgggcaccgggctgtgtggagaagtgagcgcgctcgtctgacccccgtgcccgccaccccgagccactaacggcgatctcccaaggcctgcccgaggcctctgtcctctgtcctcagccccgcagcggcaacgtcttgcactcggcgagctcgccgctcccgaccctcccgcgcccccgccctgccgcgctgctccccgcccagccgcgggtctgtggtccaagccgccccgaagcagcccgaacaagatcactcaaggtgaaggataatctactaataccagcactttgaatgaaaatttgtttctctgccacaaactgaacatcttttttttttttttttttttttggtgggggagttgaaacctaattttgtggcgtagcagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaaatcttttgtagatggcttgaattttagcttaaataacatgcagtattctaaccagcaattccagcctgttatggctaactaaaaaaaagaaaatgtatcgtacaagttaaaatgcacgggcccaagggggattttttttttcacctccttgagaatttttttttttaagcttatagtaaggatacattcaagcttggttaaaaaaataataataaaacatgcatcatttttcatttgccaaccaagcacaaagttattttatactgactgtatattttaaagtatactctcagatatggcctcttacagtatttaagatatagcaaggacatggctgatttttttttataaaaattggcactaataagtgggtttattggtcttttctaattgtataatttaatttagtacaaagtttgtaaaatatcagaggatatatatatattgtttctacgacatggtattgcatttatatctttttactacagtgatctgtgacagcagcagcttcatgttgtattttttttactgaaattgtaaaatatccatcttaaagacatcaactattctaaaaattgtgtacaggatattcctttagtggtggaattaaaatgtacgaatacttgctttttcaaaaaaatgtattttctgttaaaagtttaaagatttttgctatatattatggaagaaaaatgtaatcgtaaatattaattttgtacctatattgtgcaatacttgaaaaaaacggtataaaagtattttgagtcagtgtcttacatgttaagagggactgaaatagtttatattaagtttgtattaaaattctttaaaattaaaaa

SEQ ID NO: 31994 - DNA, 4561 bp, Homo sapiens
cagggaggggaagacggggagccggacgcacgaccggcgagcacagaagggcacaggagctgctccgcgagataccagcgagctgaggcgcggggctggctgggaagtagtcccggccgggccctggccccgcccctgcagggcggagggacgcatcacgcaggggtggggaagccggatccgtgcgcagggttgctaagggtgaaacttttcattgactttgctcacttcgggccggggcgcgggaaggtgcgggttgttggctgaggcaagccgtggctcgggcgacgcggggccaggagggcaggaccgtctgccggcgacagcccataccgtctgccgttgcgcgacacgaaccaccctccgatccgccatccccgcgtcgtcgccgctagtccgcccgcccgccctcgggccccccgctgccgagcccgacctcctaagagctgaaagaaattattgagagtcatagtccatagccccctgcttcgtcccccaaccctcaacgacgaaaaggacttcggtcccctggcccggcgacgcccgggaaggaaaggagagcgacctccgccccgcgctcaggccaccctggagggagaagccgccccgcggccggtagagcgccccgccgccgcggagacccgaagccgcctggagcccaaggctgtacacgtgccctgtgctgattctctgcctaggaaaggaccatgcagctagagatcaaagtggccctgaacttcatcatctcctacttgtacaacaagctgccccggcgccgggcagacctgtttggggaggagctagagcggcttttgaaaaagaaatatgaaggccactggtaccctgagaagccactgaaaggctctggcttccgctgtgttcacattggggagatggtggaccccgtggtggagctggccgccaagcggagtggcctggcggtggaagatgtgcgggccaatgtgcctgaggagctgagtgtctggattgatccctttgaggtgtcctaccagattggtgagaagggagctgtgaaagtgctgtacctggatgacagtgagggttgcggtgccccagagctggacaaggagatcaagagcagcttcaaccctgacgcccaggtgttcgtgcccattggcagccaggacagctccctgtccaactccccatcgccatcctttggccagtcacccagccctaccttcattccccgctccgctcagcccatcaccttcaccaccgcctccttcgctgccaccaaatttggctccactaagatgaagaaggggggcggggcagcaagtggtgggggtgtagccagcagtggggcgggtggccagcagccaccacagcagcctcgcatggcccgctcacccaccaacagcctgctgaagcacaagagcctctctctgtctatgcattcactgaacttcatcacggccaacccggcccctcagtcccagctctcacccaatgccaaggagttcgtgtacaacggtggtggctcacccagcctcttctttgatgcggccgatggccagggcagcggcaccccaggcccgtttggaggcagtggggctggcacctgcaacagcagcagctttgacatggcccaggtatttggaggtggtgccaacagcctcttcctggagaagacaccctttgtggaaggcctcagctacaacctgaacaccatgcagtatcccagccagcagttccagcccgtggtgctggccaactgaccatctacctgcccgtggggccaggagcacccaagaccacagaaaagagaaaggaaaggccaaaaaaaagaggaaaagaaaaatgtacaaaaagattttcgatcttctcactcttacttctagaaaaaagatccagcccaggcacggaatgggagggccctgcaaagcacccaagtgtgtttcactcaccccttaccgctcgcccaccggcctgtgatttatttggttggtttgggttttatatttctttttcttttttttttttcttacatgtagttttctatataacatctttaatgagtggcttcctgtgctaagaatggtccagatgtgaactgctgctccctgctcctcccttcctccttcacactcctagtttaggattgatgtgtccaagctcatagggaagaaagagctgcagctggagcctgaccctccctggaacagggagaggctggcccgtgtcactgcctctgtcacccagctatcctcgcactcaaagccatccaacctcagcaggccttctcgggccctgccacctgaataggtctgaccccagtccccactccctttcaggctgggccacagggagttgctggctggccacttgacaccctccccctggagctgatgtctgtgactacagggagattagcacttcgtctagtgaaactcctttcatctctgtcctatggccccaccccaccattccctctaggcccagaccatcatcatggccctggccattgatgtgtatgggctttctttccctcatgcagccccttcttccccaggctggatgttgtgggtagggaggggtgtgtgtgtgtgtatttggtttgctgtccttttttaaaggattccaagccatgtgaaacttcccttctggatgtgattctgggtcgcaagtccttatttatatgtgaggctggggaatgggctgggggtattggcagtccttttgcagggcagtgtgtgtggtggggtgacaccgctgtggcttagcccaagacactcccagaggaaaacactgcagaaggaactggtttgcagactgtggaaggatctgcagttttgtttttgaccaaaaaaataataataagttagctctgaagggcagagggaatacccaagcccctgatgcctatgagaagtccctggacttcaaccctcctgttgtttggccttagcccagagggagctgctcacctgagcacccttgggggtgggcagagaggcagggtgggattttagagttagtgtctgtgcgggggcagccctgagcctggagttgagactttggggtctcttagtttggaggtgttgagtgcatttgtgcccctgcctggttgagagcttcttggtacctcttgccaccccttctcactgccctgacccaaccccactggaccttgatgctgcgaggagtggtgtcctgacggactcagcactcccgcctgatgtattggatcataggagagcacttgctctcctgcctctgccaggagagggcttgttcctccaactctaggaggccaggcaagcatggacaggagccaagggagcagggtcattaactttttcttctttgcaaagtgggcacttggcatcagggtcccaatcaccagaaagcaccaaagcccctggcaccccacccactccatcctacccagggaccccaagtaggcaactgttatggcagtgggtccagcccaggccagcactgccagcctcctctccctgcagtaggcaccagctctacctcccccggcaggcaatgtcctggcttctcagcccagcaccatctgttcccctagacttctcaggggccagcccagtctgggccaccctttgtttccctcatcctcggctcccacacaggtgacagacccagcagatagcttctctctgggaaaggttggatgctgccttacatccccttctagccctcctcccatccacacacacaggcacccacccacaccaggtcggcttgtttctcacatgtagggagagaggggagaccaacccctttgtgtcttttgaaatacgaagaaaaatgtgtgttcaggagcatgactccagtgctgcgctcttgggcccagttcagtctgtcttgtctcaaatctaggcatttttgcttcaattttattttttttaagaatacaaaaacagaaatctgcactaatttacctggtttcgtaggaaaacttttttttattttttacattttttggtgtccgtttgtattgaataatttgctacatttgtaaaatgtaagaggtatataatatatgtatatttctaacgtaaaaaacataatttttttcttttcaagattttttcttaaaaagatgagagaaacatattttttcaggaaaaacaaactttaaaaaaaaaagaggagaaataaaaccttttctcccctttccccatcctctatctatccctctttcccaggaacaaatcaaaaggtggattatcttctgaagaatggaaactgttagtccagaatgatgtgtttttctcaatgcagtgagttatagattctctagttttctccctagggatgggaagggggcattgaggcaagcctggagaggagcccggggagcagggtcatgaacttttttctttagtgaaggaggaatacaatcaagggttttgtattcagaatgttgtgcaatattttggaatgggacattggtgtgtttagagattttagtttaaaaacaaaacaaaaagattgatcaaatctgtacagtttctattgttccagatttttttaagtttgtattaaaagcatgatacataatagc

SEQ ID NO: 31995 - DNA, 777 bp, Homo sapiens
ggcgcgggaaggtgcgggttgttggctgaggcaagccgtggctcgggcgacgcggggccaggagggcaggaccgtctgccggcgacagcccataccgtctgccgttgcgcgacacgaaccaccctccgatccgccatccccgcgtcgtcgccgctagtccgcccgcccgccctcgggccccccgctgccgagcccgacctcctaagagctgaaagaaattattgagagtcatagtccatagccccctgcttcgtcccccaaccctcaacgacgaaaaggacttcggtcccctggcccggcgacgcccgggaaggaaaggagagcgacctccgccccgcgctcaggccaccctggagggagaagccgccccgcggccggtagagcgccccgccgccgcggagacccgagtgaagccgcctggagcccaaggctgtacacgtgccctgtgctgattctctgcctaggaaaggaccatgcagctagagatcaaagtggccctgaacttcatcatctcctacttgtacaacaagctgccccggcgccgggcagacctgtttggggaggagctagagcggcttttgaaaaagaaatatgaaggccactggtaccctgagaagccactgaaaggctctggcttccgctgtgttcacattggggagatggtggaccccgtggtggagctggccgccaagcggagtggcctggcggtggaagatgtgcgggccaatgtgcctgaggagctgagtgtctggattgatccctttgaggtgtcctacc

SEQ ID NO: 31996 - DNA, 2312 bp, Homo sapiens
ccagtgcccccaattcgcgctcgggagtgaggagccgccaacaccccagctccgctgctgccgccaccgcagtgctctctagtcgccattggttacctaaactttccagtacccgcgacctttccgggactccgcggcggcggggcagaggcggcccaggggcggcacgcggctgctccggtgcgccgggctcttttcggccgccgcacggccgggcctcacaggctgccctcctgagagaggctcagaacacggccaggtacgcgccgccgccacagttgcgctgctagcgacgaggtgttttcctctgctggcacgccagaatccctggttcagcctggaaggcgaggggcaggactccccagacagtggcctcagtgtggcattgatgtcctaggttgtaaggtgctaaggctggtccccacagacggcttgccatttctatgactggatgctgagaagcctgctggttcagaggtccacacatgaagttaccataaagagggtggttccaacttcatcaatacctcatcgccatgaggtgaggctaagatgagcataaccagtgacgaggtgaactttctggtttatcggtatctccaggagtcaggtttttctcactcggctttcacgtttgggatcgagagccacatcagccagtccaacatcaatgggacactagtgccaccgtctgccctcatctccattctccagaagggactgcagtatgtagaggctgagataagcatcaacaaggatggcacagtgttcgacagccgccctatagagtccctgtccctgatagttgctgtgattcctgatgtggtgcagatgcggcagcaggcatttggagagaagctcactcagcagcaagccagtgcagcagccacagaggcatcagcaatggcaaaggcggcaaccatgaccccagctgctatttcccagcaaaatcctccaaagaaccgagaggccacagtgaacggggaagagaatggagcacatgaaatcaataatcactcaaagccaatggaaatagatggggatgttgagattccacccaacaaagccacagtccttcggggccacgagtctgaggtgttcatttgtgcctggaaccctgtcagtgatttgctagcctctggatctggagactcaactgcaaggatatggaacctgaatgagaatagcaacgggggctccacccagctcgtgttgagacattgtatacgagaaggggggcacgacgtcccaagtaataaagatgtcacctcactggactggaacagtgatggaacactattggctatgggttcatatgatggtttcgcaagaatatggacagaaaatggtaacctggccagcaccttaggccaacataaaggccccatcttcgctctgaaatggaacaaaaaggggaattatgttttgagtgctggtgtagacaaaacaacaataatttgggatgctcacacaggagaagccaaacagcagtttccttttcattcagcccccgcccttgatgtggactggcagaacaacatgacctttgcctcctgtagcacagacatgtgtatccatgtgtgcaggctcggctgtgaccacccagtcaaaaccttccagggacacacaaacgaggtcaatgccatcaaatgggatccttctggaatgttgctggcgtcctgctcggatgacatgacattgaagatctggagtatgaagcaggatgcatgcgtccacgatcttcaggctcacagcaaagagatctacaccatcaagtggagccccaccgggcctgccaccagcaacccaaactccagcatcatgttggcaagtgcttcatttgattctacagtgcgactgtgggatgtggagcaaggtgtctgcacccacacactcatgaagcatcaagagcctgtctacagtgtagctttcagccccgatggaaagtacttggctagtggatcctttgacaagtatgttcatatctggaatactcagagtggaagtctcgtccacagctaccaaggcactggcggtatcttcgaggtgtgctggaacgcccgaggagataaagtgggcgccagcgcgtctgatggctctgtgtgtgttctggatctgtgaaagtaaacacaaaatatagaaaaaaagaaaagaattctaatgacctgccttgaatgcatggggttgcagctctgttcaaacacaattctatcagctccaaaatgtgtgaacttgacttgtgttagagtatattctgaaaccaacttgtcccaggccacaggagtgtatatgtttcataatctttatcaaga

SEQ ID NO: 31997 - DNA, 2376 bp, Homo sapiens
ccagtgcccccaattcgcgctcgggagtgaggagccgccaacaccccagctccgctgctgccgccaccgcagtgctctctagtcgccattggttacctaaactttccagtacccgcgacctttccgggactccgcggcggcggggcagaggcggcccaggggcggcacgcggctgctccggtgcgccgggctcttttcggccgccgcacggccgggcctcacaggctgccctcctgagagaggctcagaacacggccaggtacgcgccgccgccacagttgcgctgctagcgacgaggtgttttcctctgctggcacgccagaatccctggttcagcctggaaggcgaggggcaggactccccagacagtggcctcagtgtggggaatgccagctgttctcttaacagaagggcagtttttgaagaaatgaagcaggacttgatgtggattgtcataaactgtttctccctaaagaggctggtccccacagacggcttgccatttctatgactggatgctgagaagcctgctggttcagaggtccacacatgaagttaccataaagagggtggttccaacttcatcaatacctcatcgccatgaggtgaggctaagatgagcataaccagtgacgaggtgaactttctggtttatcggtatctccaggagtcaggtttttctcactcggctttcacgtttgggatcgagagccacatcagccagtccaacatcaatgggacactagtgccaccgtctgccctcatctccattctccagaagggactgcagtatgtagaggctgagataagcatcaacaaggatggcacagtgttcgacagccgccctatagagtccctgtccctgatagttgctgtgattcctgatgtggtgcagatgcggcagcaggcatttggagagaagctcactcagcagcaagccagtgcagcagccacagaggcatcagcaatggcaaaggcggcaaccatgaccccagctgctatttcccagcaaaatcctccaaagaaccgagaggccacagtgaacggggaagagaatggagcacatgaaatcaataatcactcaaagccaatggaaatagatggggatgttgagattccacccaacaaagccacagtccttcggggccacgagtctgaggtgttcatttgtgcctggaaccctgtcagtgatttgctagcctctggatctggagactcaactgcaaggatatggaacctgaatgagaatagcaacgggggctccacccagctcgtgttgagacattgtatacgagaaggggggcacgacgtcccaagtaataaagatgtcacctcactggactggaacagtgatggaacactattggctatgggttcatatgatggtttcgcaagaatatggacagaaaatggtaacctggccagcaccttaggccaacataaaggccccatcttcgctctgaaatggaacaaaaaggggaattatgttttgagtgctggtgtagacaaaacaacaataatttgggatgctcacacaggagaagccaaacagcagtttccttttcattcagcccccgcccttgatgtggactggcagaacaacatgacctttgcctcctgtagcacagacatgtgtatccatgtgtgcaggctcggctgtgaccacccagtcaaaaccttccagggacacacaaacgaggtcaatgccatcaaatgggatccttctggaatgttgctggcgtcctgctcggatgacatgacattgaagatctggagtatgaagcaggatgcatgcgtccacgatcttcaggctcacagcaaagagatctacaccatcaagtggagccccaccgggcctgccaccagcaacccaaactccagcatcatgttggcaagtgcttcatttgattctacagtgcgactgtgggatgtggagcaaggtgtctgcacccacacactcatgaagcatcaagagcctgtctacagtgtagctttcagccccgatggaaagtacttggctagtggatcctttgacaagtatgttcatatctggaatactcagagtggaagtctcgtccacagctaccaaggcactggcggtatcttcgaggtgtgctggaacgcccgaggagataaagtgggcgccagcgcgtctgatggctctgtgtgtgttctggatctgtgaaagtaaacacaaaatatagaaaaaaagaaaagaattctaatgacctgccttgaatgcatggggttgcagctctgttcaaacacaattctatcagctccaaaatgtgtgaacttgacttgtgttagagtatattctgaaaccaacttgtcccaggccacaggagtgtatatgtttcataatctttatcaaga

SEQ ID NO: 31998 - DNA, 2407 bp, Homo sapiens
ccagtgcccccaattcgcgctcgggagtgaggagccgccaacaccccagctccgctgctgccgccaccgcagtgctctctagtcgccattggttacctaaactttccagtacccgcgacctttccgggactccgcggcggcggggcagaggcggcccaggggcggcacgcggctgctccggtgcgccgggctcttttcggccgccgcacggccgggcctcacaggctgccctcctgagagaggctcagaacacggccaggtacgcgccgccgccacagttgcgctgctagcgacgaggtgttttcctctgctggcacgccagaatccctggttcagcctggaaggcgaggggcaggactccccagacagtggcctcagtgtggcattgatgtcctaggttgtaaggtgctaaggggaatgccagctgttctcttaacagaagggcagtttttgaagaaatgaagcaggacttgatgtggattgtcataaactgtttctccctaaagaggctggtccccacagacggcttgccatttctatgactggatgctgagaagcctgctggttcagaggtccacacatgaagttaccataaagagggtggttccaacttcatcaatacctcatcgccatgaggtgaggctaagatgagcataaccagtgacgaggtgaactttctggtttatcggtatctccaggagtcaggtttttctcactcggctttcacgtttgggatcgagagccacatcagccagtccaacatcaatgggacactagtgccaccgtctgccctcatctccattctccagaagggactgcagtatgtagaggctgagataagcatcaacaaggatggcacagtgttcgacagccgccctatagagtccctgtccctgatagttgctgtgattcctgatgtggtgcagatgcggcagcaggcatttggagagaagctcactcagcagcaagccagtgcagcagccacagaggcatcagcaatggcaaaggcggcaaccatgaccccagctgctatttcccagcaaaatcctccaaagaaccgagaggccacagtgaacggggaagagaatggagcacatgaaatcaataatcactcaaagccaatggaaatagatggggatgttgagattccacccaacaaagccacagtccttcggggccacgagtctgaggtgttcatttgtgcctggaaccctgtcagtgatttgctagcctctggatctggagactcaactgcaaggatatggaacctgaatgagaatagcaacgggggctccacccagctcgtgttgagacattgtatacgagaaggggggcacgacgtcccaagtaataaagatgtcacctcactggactggaacagtgatggaacactattggctatgggttcatatgatggtttcgcaagaatatggacagaaaatggtaacctggccagcaccttaggccaacataaaggccccatcttcgctctgaaatggaacaaaaaggggaattatgttttgagtgctggtgtagacaaaacaacaataatttgggatgctcacacaggagaagccaaacagcagtttccttttcattcagcccccgcccttgatgtggactggcagaacaacatgacctttgcctcctgtagcacagacatgtgtatccatgtgtgcaggctcggctgtgaccacccagtcaaaaccttccagggacacacaaacgaggtcaatgccatcaaatgggatccttctggaatgttgctggcgtcctgctcggatgacatgacattgaagatctggagtatgaagcaggatgcatgcgtccacgatcttcaggctcacagcaaagagatctacaccatcaagtggagccccaccgggcctgccaccagcaacccaaactccagcatcatgttggcaagtgcttcatttgattctacagtgcgactgtgggatgtggagcaaggtgtctgcacccacacactcatgaagcatcaagagcctgtctacagtgtagctttcagccccgatggaaagtacttggctagtggatcctttgacaagtatgttcatatctggaatactcagagtggaagtctcgtccacagctaccaaggcactggcggtatcttcgaggtgtgctggaacgcccgaggagataaagtgggcgccagcgcgtctgatggctctgtgtgtgttctggatctgtgaaagtaaacacaaaatatagaaaaaaagaaaagaattctaatgacctgccttgaatgcatggggttgcagctctgttcaaacacaattctatcagctccaaaatgtgtgaacttgacttgtgttagagtatattctgaaaccaacttgtcccaggccacaggagtgtatatgtttcataatctttatcaaga

SEQ ID NO: 31999 - DNA, 2675 bp, Homo sapiens
aattcgcgctcgggagtgaggagccgccaacaccccagctccgctgctgccgccaccgcagtgctctctagtcgccattggttacctaaactttccagtacccgcgacctttccgggactccgcggcggcggggcagaggcggcccaggggcggcacgcggctgctccggtgcgccgggctcttttcggccgccgcacggccgggcctcacaggctgccctcctgagagaggctcagaacacggccaggtacgcgccgccgccacagttgcgctgctagcgacgaggtgttttcctctgctggcacgccagaatccctggttcagcctggaaggcgaggggcaggactccccagacagtggcctcagtgtggcattgatgtcctaggttgtaaggtgctaaggggaatgccagctgttctcttaacagaagggcagtttttgaagaaatgaagcaggacttgatgtggattgtcataaactgtttctccctaaagaggctggtccccacagacggcttgccatttctatgactggatgctgagaagcctgctggttcagaggtccacacatgaagttaccataaaggtttttctcactcggctttcacgtttgggatcgagagccacatcagccagtccaacatcaatgggacactagtgccaccgtctgccctcatctccattctccagaagggactgcagtatgtagaggctgagataagcatcaacaaggatggcacagtgttcgacagccgccctatagagtccctgtccctgatagttgctgtgattcctgatgtggtgcagatgcggcagcaggcatttggagagaagctcactcagcagcaagccagtgcagcagccacagaggcatcagcaatggcaaaggcggcaaccatgaccccagctgctatttcccagcaaaatcctccaaagaaccgagaggccacagtgaacggggaagagaatggagcacatgaaatcaatgcggtggctcttgcctataatcccagcacttgggaggcccaaggaagaagactgattgaatctaggagttcaagaccagactgggaaagagagaaagacctcggctttacagaaaatgtagaaatcagccagataatcactcaaagccaatggaaatagatggggatgttgagattccacccaacaaagccacagtccttcggggccacgagtctgaggtgttcatttgtgcctggaaccctgtcagtgatttgctagcctctggatctggagactcaactgcaaggatatggaacctgaatgagaatagcaacgggggctccacccagctcgtgttgagacattgtatacgagaaggggggcacgacgtcccaagtaataaagatgtcacctcactggactggaacagtgatggaacactattggctatgggttcatatgatggtttcgcaagaatatggacagaaaatggtaacctggccagcaccttaggccaacataaaggccccatcttcgctctgaaatggaacaaaaaggggaattatgttttgagtgctggtgtagacaaaacaacaataatttgggatgctcacacaggagaagccaaacagcagtttccttttcattcagcccccgcccttgatgtggactggcagaacaacatgacctttgcctcctgtagcacagacatgtgtatccatgtgtgcaggctcggctgtgaccacccagtcaaaaccttccagggacacacaaacgaggtcaatgccatcaaatgggatccttctggaatgttgctggcgtcctgctcggatgacatgacattgaagatctggagtatgaagcaggatgcatgcgtccacgatcttcaggctcacagcaaagagatctacaccatcaagtggagccccaccgggcctgccaccagcaacccaaactccagcatcatgttggcaagtgcttcatttgattctacagtgcgactgtgggatgtggagcaaggtgtctgcacccacacactcatgaagcatcaagagcctgtctacagtgtagctttcagccccgatggaaagtacttggctagtggatcctttgacaagtatgttcatatctggaatactcagagtggaagtctcgtccacagctaccaaggcactggcggtatcttcgaggtgtgctggaacgcccgaggagataaagtgggcgccagcgcgtctgatggctctgtgtgtgttctggatctgtgaaagtaaacacaaaatatagaaaaaaagaaaagaattctaatgacctgccttgaatgcatggggttgcagctctgttcaaacacaattctatcagctccaaaatgtgtgaacttgacttgtgttagagtatattctgaaaccaacttgtcccaggccacaggagtgtatatgtttcataatctttatcaagaagtttgttgtttttttttgagttggagttttgctcttgttgcccaggctagagtgcagtggtgtgatctcggctcagtgcatcttctgcctcttgggttcaagtgattctcctgcctcagcctcccaagtagctgggattacaggcatgcggacatgacgctcagctaattttgtatttttagtagagacagggttttaccatgttggttaggctggtctcgtactcctgacctcaggtgatccacccacctt

SEQ ID NO: 32000 - DNA, 5866 bp, Homo sapiens
gggccggcggcgggggcggacccctggcggtcctcctggctggggtccgcgcgctcgcggcagctccccgtggaggtcactgtccgtgccagtccctcccgctgtcccgccctctcccgctgccgccgccgccgccgccgcgcccgcctcagcgcccccactccgcgcttgggagcgaggagccgccagcgcccccgccccgccgccgccgcagcgccctcaggccgccattcgccaccgaaactttccagcgcccgcgctctctccgggactcggcggcggcggggcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgagatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaaatcaccttgtgtgttgtagctcatttgtttcaagagagaatcaacagatcatattcagtgtcttgaataaattgctctattttgatatta

SEQ ID NO: 32001 - DNA, 4674 bp, Homo sapiens
gcccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaagctcctggcaaccactattccactccctgcttctttgaatttcacaacttgaggtagcttgtgtaagtggaattattttaaaagctggttcatgttaaagtgcttagaacagagcttggtgagcatccggtcaacagctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcct

SEQ ID NO: 32002 - DNA, 5596 bp, Homo sapiens
attgcatgtaatacctcagcatcagtctgcacaagcccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaaatcaccttgtgtgttgtagctcatttgtttcaagagagaatcaacagatcatattcagtgtcttgaataaattgctctattttgatattaga

SEQ ID NO: 32003 - DNA, 565 bp, Homo sapiens
ccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggc

SEQ ID NO: 32004 - DNA, 496 bp, Homo sapiens
gcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgagatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgcc

SEQ ID NO: 32005 - DNA, 5451 bp, Homo sapiens
attgcatgtaatacctcagcatcagtctgcacaagcccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaaatcaccttgtgtgttgtagctcatttgtttcaagagagaatcaacagatcatattcagtgtcttgaataaattgctctattttgatattaga

SEQ ID NO: 32006 - DNA, 520 bp, Homo sapiens
tctgcacaagcccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagagagggtggttcccacttcatcaacacctcatcgccgcgaggtgaggctaagatgagcataaccagtgacgaggtg

SEQ ID NO: 32007 - DNA, 387 bp, Homo sapiens
caacttgaggtagcttgtgctggtccctgcagacggcttcccatttttatgaccggatgctgggaagcctgctggtccacaggtccatacatgaagtcaccataaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagagagggtggttcccacttcatcaacacctcatcgccgcgaggtgaggctaagatgagcataaccagtgacgaggtgaactttctggtgtatcggtatctccaggagtcaggtttttcccactcggctttcacgtttgg

SEQ ID NO: 32008 - DNA, 2101 bp, Homo sapiens
agcatcagtctgcacaagcccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcg

SEQ ID NO: 32009 - DNA, 2430 bp, Homo sapiens
ccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaatacgaa

SEQ ID NO: 32010 - DNA, 2165 bp, Homo sapiens
gttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaatacg

SEQ ID NO: 32011 - DNA, 2620 bp, Homo sapiens
gcgcggtgacgccatcgcagcgcgccgggagtgtggcgttctgtgaagagttcggtgctaacctccctcacgcggcggtggctgccgggaccctagcaggtttcagctggagcggcggcggcggcaacatggcagagaccgcggccggagtgggccgcttcaagaccaactatgctgtggagcgcaaaattgagcctttctacaagggcggaaaagcacagctggaccagactggccagcacctcttctgcgtctgtggcaccagagtcaacattctggaagtggcctcgggggccgtgctgcggagtctggagcaggaggaccaggaggacatcactgcctttgacctcagccctgacaacgaggtgctggtgacagccagtcgggcattgctgctggctcagtgggcctggcaagagggcagcgttacccgcctgtggaaggcgatacacacggcccccgtggccaccatggccttcgaccccacctccactctgctagccacaggtggctgtgatggggccgtgcgcgtctgggacatcgtgcggcactacgggacacaccacttccgaggctcgcccggtgtcgtgcacctagtggccttccacccggaccctacacgcctgctgctcttctcctcggccacggatgccgccatccgcgtgtggtcactgcaggaccggtcatgcctggctgtgctgactgcccactacagcgccgtcacctcactggccttcagcgccgacggccacaccatgctcagctccggccgtgacaagatatgtatcatctgggaccttcagagctgccaggccacgaggaccgtgcctgtgtttgagagcgtggaggctgctgtgctgttgccagaggagccagtgtcccagctgggtgtgaagtccccagggctgtactttctgacagctggcgaccaaggcactctgcgcgtgtgggaggcagcttctgggcagtgtgtgtacacgcaggcccagccgccgggccctgggcaggagctgacccactgcaccctggcacacaccgccggcgtggtcctcaccgccaccgccgaccacaacctgttgctctacgaggctcgctccctgcggctgcagaaacagttcgctggctacagtgaggaggttttggatgtccggtttcttgggcccgaggactcccacgttgtcgtggcctccaatagcccctgcctaaaagtgtttgagctgcagacgtcagcctgccagatcctccacggccacacggatatcgtcctggccctggatgtgttccggaaggggtggctctttgccagctgtgccaaggatcagagcgtccgtatctggagaatgaacaaggctggccaggtgatgtgcgtggctcagggttccggtcacacacacagtgtgggcaccgtctgctgctctaggctgaaggagtccttcctggtgacaggcagccaggactgcactgtgaagctgtggcctcttcccaaagccttgctgtccaagaacacagccccagacaacggccctatcctcctgcaggcccagaccactcagcgctgccatgataaggacatcaacagcgtggctattgcccccaacgacaagctgctggccacaggctcacaggaccgcacggccaagctctgggccctgccacagtgccagctgctgggtgtcttctcaggccaccggcgtggcctctggtgcgtccagttctctcccatggaccaggtgctggccacggcctcagctgatggcaccatcaagctctgggcactccaggacttcagctgtctcaagacatttgaggggcacgatgcttctgtgctgaaggtggcctttgtgagccgtggcacgcagctgctgtccagcggttcggatggcctcgtgaagctctggaccatcaagaacaacgagtgtgtgcggacgctggatgcccacgaggacaaggtctgggggctgcactgcagccggctggacgaccacgccctcactggggccagtgactcccgagtcatcctctggaaggatgtgaccgaggcggagcaggcagaggagcaggccaggcaagaggagcaggtggtcaggcagcaagagctggacaacctgctgcatgagaagcggtacctgcgggcgctgggcctggccatctccctggatcggccccacaccgtgctgactgtcatccaggccatccggagggaccctgaggcctgcgagaagctggaagccaccatgctccgactgcggcgcgaccagaaagaggccctgctgcgcttctgcgtcacgtggaacaccaactcgcggcactgccacgaggcccaggccgtgctgggtgtgctcttgaggcgagaggcccccgaggagctgctggcctacgaaggcgtgcgggcagcgcttgaggccctgctgccctacactgagcggcactttcagcggctcagcaggaccctccaggccgccgctttcttggacttcctgtggcacaacatgaagctccctgtgccggccgccgcccccaccccctgggaaacccataaaggcgcactgccctagccggtccggcctctctccagtccatcctgaacccctggaaaacccataaaggccgctctcctggc

SEQ ID NO: 32012 - DNA, 6803 bp, Homo sapiens
gcgcggtgacgccatcgcagcgcgccgggagtgtggcgttctgtgaagagttcggtgctaacctccctcacgcggcggtggctgccgggaccctagcaggtttcagctggagcggcggcggcggcaacatggcagagaccgcggccggagtgggccgcttcaagaccaactatgctgtggagcgcaaaattgagcctttctacaagggcggaaaagcacagctggaccagactggccagcacctcttctgcgtctgtggcaccagagtcaacattctggaagtggcctcgggggccgtgctgcggagtctggagcaggaggaccaggaggacatcactgcctttgacctcagccctgacaacgaggtgctggtgacagccagtcgggcattgctgctggctcagtgggcctggcaagagggcagcgttacccgcctgtggaaggcgatacacacggcccccgtggccaccatggccttcgaccccacctccactctgctagccacaggtggctgtgatggggccgtgcgcgtctgggacatcgtgcggcactacgggacacaccacttccgaggctcgcccggtgtcgtgcacctagtggccttccacccggaccctacacgcctgctgctcttctcctcggccacggatgccgccatccgcgtgtggtcactgcaggaccggtcatgcctggctgtgctgactgcccactacagcgccgtcacctcactggccttcagcgccgacggccacaccatgctcagctccggccgtgacaagatatgtatcatctgggaccttcagagctgccaggccacgaggaccgtgcctgtgtttgagagcgtggaggctgctgtgctgttgccagaggagccagtgtcccagctgggtgtgaagtccccagggctgtactttctgacagctggcgaccaaggcactctgcgcgtgtgggaggcagcttctgggcagtgtgtgtacacgcaggcccagccgccgggccctgggcaggagctgacccactgcaccctggcacacaccgccggcgtggtcctcaccgccaccgccgaccacaacctgttgctctacgaggctcgctccctgcggctgcagaaacagttcgctggctacagtgaggaggttttggatgtccggtttcttgggcccgaggactcccacgttgtcgtggcctccaatagcccctgcctaaaagtgtttgagctgcagacgtcagcctgccagatcctccacggccacacggatatcgtcctggccctggatgtgttccggaaggggtggctctttgccagctgtgccaaggatcagagcgtccgtatctggagaatgaacaaggctggccaggtgatgtgcgtggctcagggttccggtcacacacacagtgtgggcaccgtctgctgctctaggctgaaggagtccttcctggtgacaggcagccaggactgcactgtgaagctgtggcctcttcccaaagccttgctgtccaagaacacagccccagacaacggccctatcctcctgcaggcccagaccactcagcgctgccatgataaggacatcaacagcgtggctattgcccccaacgacaagctgctggccacaggctcacaggaccgcacggccaagctctgggccctgccacagtgccagctgctgggtgtcttctcaggccaccggcgtggcctctggtgcgtccagttctctcccatggaccaggtgctggccacggcctcagctgatggcaccatcaagctctgggcactccaggacttcagctgtctcaagacatttgaggggcacgatgcttctgtgctgaaggtggcctttgtgagccgtggcacgcagctgctgtccagcggttcggatggcctcgtgaagctctggaccatcaagaacaacgagtgtgtgcggacgctggatgcccacgaggacaaggtctgggggctgcactgcagccggctggacgaccacgccctcactggggccagtgactcccgagtcatcctctggaaggatgtgaccgaggcggagcaggcagaggagcaggccaggcaagaggagcaggtggtcaggcagcaagagctggacaacctgctgcatgagaagcggtacctgcgggcgctgggcctggccatctccctggatcggccccacaccgtgctgactgtcatccaggccatccggagggaccctgaggcctgcgagaagctggaagccaccatgctccgactgcggcgcgaccagaaagaggccctgctgcgcttctgcgtcacgtggaacaccaactcgcggcactgccacgaggcccaggccgtgctgggtgtgctcttgaggcgagaggcccccgaggagctgctggcctacgaaggcgtgcgggcagcgcttgaggccctgctgccctacactgagcggcactttcagcggctcagcaggaccctccaggccgccgctttcttggacttcctgtggcacaacatgaagctccctgtgccggccgccgcccccaccccctgggaaacccataaaggcgcactgccctagccggtccggcctctctccagtccatcctgaacccctggaaaacccataaaggccgctctcctggccggctctgtctctctggactgcagtccagccccccaccctggccaacaccctacctagccagccagaagggcactggagctgatggtctcggccctgccacgcccatcccgcaccctggcctggcagagatccagcccgcggctccgcacgcttagacggtgggggtcatgcagaacaagctttactcagaggaacagcaaatggccccctcccatccctgctggccagggagatccgccctccccgctcctccccagccctgggatggcgcggtccatcccctcatcgggatcctcgcgctcactgctccgtcgtggggtgcggcacagagtccacgcaccctcgagggcggccctggcgccgtgggcgccgctccagggccctgcgtgtgacggtgcagcagcggctctggatggcgcccggcgaaggtcgggtgggcacggtggggggaggggcggtggcctgggagggttcagggaagccccgggcctcacccgccgggtcgtctcctccacggaaccccgtcccgctcaggagagcgcccagcccttccggccgcagcagcaccgcggggagtaggcccgcccggtcgccgtacctgcgaggggcggggtgtggttagggccccgcccgcctcggctagcctgccctgcccacgcccgctcccgcgtacctgcatagccaccagccgcggtctgacgtttccaacacgcgcacgcgcgcccccgcgggcacggacagctcatctgcgcggctgctctcgtaggcgcgggaagcacagaactggggacctggtgggagtgggtgtttggagtcaccgcggggccacagaggacgaggcccgcccgcacccttctccacattctccttgcttgagtctgctgacggcggggccgctctaagaccggttcggggcttcctctaggtgcggagaccaagcacgggctcctggcccgccctgcccgcggtgcttctggcccagtcttgccacacggtcaagccgcagtggtggcgtgaggggtggggttaggcgcataccgctgctccctagggacgggcctccctcccggccttggcccggggccgcctcctccaggtagggcgctggaaaccaggcggtctgccggtcttcgttctccaccagccaccagcctgtgcgcaagaagcgggcagggactcaaatctcgaggctccctcgggtccaggagcagaggagcaaatccctgggttcttggggggccctacctgaggggtgccgcagcagcacgtccaggctctcctgggcctgcgcctgaaaaggcctatcccgcgtgtcctgggtacagaagggctgcaggcagcgcaggctctgagcctccagactgtggatggagaggcggcccgcagcgcgagaaagaggctgctcctctggggtgggcaggatcacccggctgggaagggcagcccgtacgagtgagaggtaggcggatggggagggtgaaactgggggcgccaccccggcaagaccgccagcctcccactctctgcccctattcgctggctgttcccccccaccctggacctctcccagctccaaacgccgctgcatgctgggagtttggggcgagtcaggcacctgccgggtggcagcgcgggctccaggtccaggggttgcggtgcgaagaagccagtgatcgtcgggctccgtgccacgcgctctgcagtcgccagcagcctccgagaataggtttccaacagctgcaggcgcgccaggccgcggctcgtgcgccccacgcgtcccaacagtggtgcatcttaaggcaccacaaaaacgtactgtgatacgccgctttgggcttcactggtccctggcgcccccaggcaagccaccgccttccccgctcccgtacccaggctggcctgaccgagaagctttgggagaacgcggtcagatctccgcagcaggcccgcctccaccgggaaggtctccttgagggtcttctgagggcgggaaccagggcattggtcttccagagcccactgtgcacccttgagagggcggggtccctcacccggatggcaggggctgggagcttcagcagggacgaagggcctccagtgggagtcactgatgggaggcagtccagtgggaggcagccgcgtggggaagccgccaccgcggcatcagggtggcccagggtcactcaccttgagctgcctgaattcgtcccaactcctgcgcacgaaggtgtcgctgccgtctgaccagcgcacagagaaggcaaacgtctgggggacaaaaagttgggagtgccgtggaggtgctggtccaggcacccccttcctatcccttggggccactaaggacccagccaggtcttacttggagcctcttgatctgcaccagggctgccccttgcactgaaactgggtatcgggggcctgccatggctgtggcttccaggctgcagattcctgaaatgggcgaggacccttctgcctccccgtgcttgagagggctctgggggacccagaaaaccccctgggatagaatcctggcaacacctcaagcctgtggggtccttgtggagccgccccagctgagtcctttgcagctttcttgctgtcccccaagcccacgatctgggggcaggagcacagggattgggggacttccaggcagagctgctgggaggaagaagaagaatgagctttccagccctggaggcgtgcaagactgaagaaggggcgaagggtaggcgggactgctgcctggggccctcctgcctgcctctggccacaggaggagggaggagaaggcagggctaatcaaagcgccacctgtcctgcccacctctctggattcccctaccctgtgaggtaattgccctgccagggtgcgcccaacaactttgaactggcctggggatttctgtgcagaaccaaggactcagtgcttacagctttaagtgctttgtctgacttaatcctaatgctggaggaaaggtctcttaatgtccccaactcatagaggaggaaatgtgtgttaaatgcgtaattattgtgagctgttctatacatgctgggggaggggcagacctcacaggctcaccccaggggttcccctgcagtgaggagacttggggtaggagaaagagggcccatctgtgcagtcactggcatttggtgggtgggggtggtggtcagggaagtggtcactagggctgttttgagaaccacctctcaattcacgatttgccatgacttactgcaaacatggcctgggcagaggctcgcccaggtgccccacctctctggctgcttccttatagttcgggcttcggaagccacattcaaccctggcacacagtggtttttcctcgtgctggggccaccagttctgtgttgggatgcacctactccagccccttcagggagcagtcagcctctaaggcatccctccaggaagctgccctggctgcaacaaagggcctttgtgtgtctgtcccaccagcactctctctcatgccctcaagctgtccctggtcttggcatgggcaatgaacacctgctcacatagggctgatttgcagggttcccccagccagctgtcaccttctccctgtctcagctgagggcccagctgacctggtggggtccagcgtgtgaacccaggggagaccttgctcccctggaagacaggagaagctggggaggatttattcacaagcagaggcctagagggattctgaggccacctgcctaccccagctgacagctcctgccccacaccccatcagccctgcatggtttccactttttcctcccctaccctcttttcttgcctgaatagtacaccccaccctccatctgtatgctcctcacttgcccctacaaaatccactccaaggacagacacagtgcctcacctgtaatccaagtactttgggaggccgaggcagggggattgcttgagctcaggagttcgagaccagtctgggcaacatgttgagacctccatctgtgccccccaaaaatacaaaaattagctgggcgtggtggcgtgtgcctgtagtctacttgggaggctgaggtgggagatcacttgagcctaagcagtcgcggctgcagtgaacaagatcgcgccactgcactccaccctgggtaacggaacaagaccctgtctcaaaaaaaaaaaagaaa

SEQ ID NO: 32013 - DNA, 3294 bp, Homo sapiens
aggagaagagcaaagaaaagcagtccgtctggatttgtttgcccaggactggcgccgcgcacgcggatcgccgaggggagtgcggtcggagtcaccgcgcccccgcctccccgcccgggcagctgaggccgggggttggagcgctgcccccgcgcacagtccccgagcgcccgacgtctccgcgcaggttcttgaagcagctgggcctggggcgcccactaatgtggccctgagggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagaattgaatgccatcatcggggtacgtggcctaccaggtctacctcctacacagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagaggtgagaggccgggcaagagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcggcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaacctgcatactccttccacgttactgcagacggtcagatgcagcctgtcccttttccccccgacgccctcatcggacccggaatcccccggcatgctcgccagatcaacaccctcaaccacggggaggtggtgtgcgctgtgaccatcagcaaccccacgagacacgtgtacacaggcgggaagggctgcgtcaaggtctgggacatcagccaccctggcaataagagccctgtctcccagctcgactgtctgaacagagacaattatatccgttcctgtaaattgctacccgatggctgcactctcatagtgggaggggaagccagtactttgtccatttgggacctggcggctccaaccccgcgcatcaaggcggagctgacgtcctcggcccccgcctgctacgccctggccatcagccccgattccaaggtctgcttctcatgctgcagcgacggcaacatcgctgtgtgggatctgcacaaccagacactagtgaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccagatcttctccctggggtactgccccaccggggagtggctggcagtgggcatggagagcagcaatgtggaggtgctgcacgtgaacaagcctgacaagtaccagctgcacctgcatgagagctgcgtgctgtccctgaaatttgcttactgtggtaaatggtttgtgagtactggaaaagataacctcctcaatgcttggcggaccccctatggagccagcatattccagtccaaagagtcctcgtcagtgcttagctgtgacatctctgtggatgataagtacatagtcactggctcgggggacaagaaggctacagtctatgaagtcatctactgaaaacattatgtggtttaacgtttatagttgaattgggccaaaatgtttcgaatttatagaaatagaaaagttgtaactttaaaagagaaaaaaaattacaaacacctgtttccaaaccttgacagaaaactactttgagtctacaaagaggaggcgacaagtccatcagcagaaagtcacctgtctacatagaccaaatggagcaccaaggccaagcggacagaggggccatgggttgtaggattgaggaacggaatctgccgactcacatgacagcccattctttctttctgggtgatctggggatcacgccttgcccaagtgtgagattacctttctgttccttgcagttcacctcactttccgtcctttgtagagcagtggtgtctccaatgaacttgtttcctggttttgcatcttgtgaaatgtttttttgtatttttgttgaaggttaaacatttgtataaattgtaaatatatttggtttattacagtaaaggctttagtacc

SEQ ID NO: 32014 - DNA, 1115 bp, Homo sapiens
gaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagaattgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagaggtgagaggccgggcaagccagattaggactttgtcctcatactcttacagtgctgcaaagttgtgtgcatcgctaaagagagccccaacctatacagagagcaaacaatgagataagaggaactgtcgcaaagctttccactgaaacacaggtcaccctggaagtttgcagggtttgctgtgggcatctgtagatttctcgatctcgttagattgcaggcatcttgacatcttggcaactgcctagttaatgccagtggcctgtaccatattatggaaaactgttaactgcttaattgggtaattttcaaagaaagtaatgttgttaaatggggcgaaataagaagttaaatttgaaagtgaatgtgttcaaatgaaaggtttgataattgcatctgttactacttagtttcataggctttaattctagtatgcattaaatattgggcaaaattgcacttgactaattttttgaagaaaagtaatttattctgtcaagaaataaaaaaataggctttgtgtatggttaaactgtaaatcttatgtttacaaaatactgtaattttcaggaaatcactgtattaggaatgtgcaatgacttatataaataaaagccatttttaaaactg

SEQ ID NO: 32015 - DNA, 1800 bp, Homo sapiens
aggagaagagcaaagaaaagcagtccgtctggatttgtttgcccaggactggcgccgcgcacgcggatcgccgaggggagtgcggtcggagtcaccgcgcccccgcctccccgcccgggcagctgaggccgggggttggagcgctgcccccgcgcacagtccccgagcgcccgacgtctccgcgcaggttcttgaagcagctgggcctggggcgcccactaatgtggccctgagggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagaattgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcggcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaaccgagccttgttcctgccccagcacattga

SEQ ID NO: 32016 - DNA, 666 bp, Homo sapiens
gcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcggcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaaccgagccttgttcctgccccagcacattgagaagtttggaaacgtgtaattgatagaggaagttaggtcctagaactcagaatcttaaatgttgactttggctggaatacttcctcatttatcaacttaggtcatctgtttcttgttttctttgcttgtaatcttcttttacatatccattttaagaagttttgtatttgcctttaaaaaaaataaatgaaaatagagtgtatgcctctaaataaggaaacaaa

SEQ ID NO: 32017 - DNA, 3893 bp, Homo sapiens
tttgcccgccggggagggtggccgattggcggagcgcactcctgctgttttccccaccatctcgtggatgtcgtccctcgggtggtgagagaactttgcagtgggctggagcgccctttgcggagaagcacacgaaggtgaaggaaggaaagaaagaagaccgaggaagaaggagctcggaagaagggtccggagcggccggtccggccgtgcagggcgagtgcgcccgaggcgcggcgccctgatgctccccgggctcgaggagcattgggcacttgcgggactgctctcggtggagtagccccgtcgggcccggagggtttgtgcaaccgcggagaacaccgagtgctggtcgcacggggcgtgccgagccgcctcccggcgcgccctccgcactttccccgcctcgtcatccgtcgctccccggccaggagcctccgctgcgtcttcaacctcgctcccctttgcgtcccgggagcctgcgagcacccggccgaaggcgcagccgaatcttgcgggagtcgccccgaaagcgtcgggtttgtgtggggttagcgggggccgccgcgccacctgcacctcgcccgccgccgcctcggggaaagcccgaagaggaggcggaccaggagaagagcaaagaaaagcagtccgtctggatttgtttgcccaggactggcgccgcgcacgcggatcgccgaggggagtgcggtcggagtcaccgcgcccccgcctccccgcccgggcagctgaggccgggggttggagcgctgcccccgcgcacagtccccgagcgcccgacgtctccgcgcaggttcttgaagcagctgggcctggggcgcccactaatgtggccctgagggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagaattgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcggcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaacctgcatactccttccacgttactgcagacggtcagatgcagcctgtcccttttccccccgacgccctcatcggacccggaatcccccggcatgctcgccagatcaacaccctcaaccacggggaggtggtgtgcgctgtgaccatcagcaaccccacgagacacgtgtacacaggcgggaagggctgcgtcaaggtctgggacatcagccaccctggcaataagagccctgtctcccagctcgactgtctgaacagagacaattatatccgttcctgtaaattgctacccgatggctgcactctcatagtgggaggggaagccagtactttgtccatttgggacctggcggctccaaccccgcgcatcaaggcggagctgacgtcctcggcccccgcctgctacgccctggccatcagccccgattccaaggtctgcttctcatgctgcagcgacggcaacatcgctgtgtgggatctgcacaaccagacactagtgaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccagatcttctccctggggtactgccccaccggggagtggctggcagtgggcatggagagcagcaatgtggaggtgctgcacgtgaacaagcctgacaagtaccagctgcacctgcatgagagctgcgtgctgtccctgaaatttgcttactgtggtaaatggtttgtgagtactggaaaagataacctcctcaatgcttggcggaccccctatggagccagcatattccagtccaaagagtcctcgtcagtgcttagctgtgacatctctgtggatgataagtacatagtcactggctcgggggacaagaaggctacagtctatgaagtcatctactgaaaacattatgtggtttaacgtttatagttgaattgggccaaaatgtttcgaatttatagaaatagaaaagttgtaactttaaaagagaaaaaaaattacaaacacctgtttccaaaccttgacagaaaactactttgagtctacaaagaggaggcgacaagtccatcagcagaaagtcacctgtctacatagaccaaatggagcaccaaggccaagcggacagaggggccatgggttgtaggattgaggaacggaatctgccgactcacatgacagcccattctttctttctgggtgatctggggatcacgccttgcccaagtgtgagattacctttctgttccttgcagttcacctcactttccgtcctttgtagagcagtggtgtctccaatgaacttgtttcctggttttgcatcttgtgaaatgtttttttgtatttttgttgaaggttaaacatttgtataaattgtaaatatatttggtttattacagtaaaggctttagtaccaataa

SEQ ID NO: 32018 - DNA, 936 bp, Homo sapiens
gggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagaattgaatgccatcatcggggtacgtggcctaccaggtctacctcctacacagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataagga

SEQ ID NO: 32019 - DNA, 2483 bp, Homo sapiens
gaaaattgtactgagaattagaacttctgcaagggctcaagagtgtcagctagtaataataataataacaatagctgaagtgcaatggtgcaatcacggctcactgcaacctccgcctcccaagattctcctgcttcaggattacagaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcgtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatca

SEQ ID NO: 32020 - DNA, 2704 bp, Homo sapiens
tcgccgcgctcccgccccggccgctgcccctgcccgccccgctcgccccgcgcaccccaacccggggaggggctcccacgaccccgggcgcgcgcgcttgggggcgcgccagggactccagggtcccttgccccgcgccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacatccgc

SEQ ID NO: 32021 - DNA, 1088 bp, Homo sapiens
ctggcccatggcgaggtggtctgcgcggtcaccatcagcggctccacacagcatgtgtacacgggcggcaagggctgtgtgaaggtgtgggacgtggatggggcagtgtttgcaggtcaaaggggcggggctcaccagccaatcaggaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacatccgc

SEQ ID NO: 32022 - DNA, 2121 bp, Homo sapiens
atggtgcaatcacggctcactgcaacctccgcctcccaagattctcctgcttcaggattacagaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcgtccaaggagtcgtcctcagtcctgagttgtga

SEQ ID NO: 32023 - DNA, 1343 bp, Homo sapiens
tcgccgcgctcccgccccggccgctgcccctgcccgccccgctcgccccgcgcaccccaacccggggaggggctcccacgaccccgggcgcgcgcgcttgggggcgcgccagggactccagggtcccttgccccgcgccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgccgtggcccagctcgactgcc

SEQ ID NO: 32024 - DNA, 2108 bp, Homo sapiens
agaaaagccatttccgactccagactggtccccgctccccgcaagcccccccccccgctcccacgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagact

SEQ ID NO: 32025 - DNA, 2492 bp, Homo sapiens
agatgaaatccttcccttgagtgtggcgtgctgagatctccacctggaggcatccccagctggtagatcagtcctgggaagcggaggagaccaagaaaggggccttgcctgggacagacgtgggccaagccggggctggaatctgggactccaggcggaggcccctttcctttgtttcagctgagcccagcacctctgagtgtctgcgtctgagcggagattgtgaagcgtctgagcggtatctgcgctcagattatccccttcctgacccaggagcatcagcagcaggtgctccaggccgtagaacgcgccaagcaggtcaccgtgggggagctgaacagcctcatcggggtgagtctctctagcccctgccccgccatggggagacgcccactcccaggtccctggcacccacccaggaggtgttaaagctggggtggtgtgtgggccttggctccagtggtcctgggaaccccaggggcacatgctgtgcttaggtcccatcccctgtgtctacctcttgggctggggaccgctgggctcctgccgccccccgccccggcccatcctgcctcctttctagcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggc

SEQ ID NO: 32026 - DNA, 2346 bp, Homo sapiens
cagaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcgtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacatccgc

SEQ ID NO: 32027 - DNA, 2253 bp, Homo sapiens
ccccgctcgccccgcgcaccccaacccgcccccccagaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacatccgc

SEQ ID NO: 32028 - DNA, 5207 bp, Homo sapiens
gctctcgcggcagttcagacctcgtgctcgtccccttcgcctgtctgtgtgtggtatccgtaggtccggggcacttttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccggcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggcttttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgctttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattccc

SEQ ID NO: 32029 - DNA, 2657 bp, Homo sapiens
atttaagcatctatcatggcagggtaaacgaggcagtttatctggcacctccattttgcttgttgctacctttatggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccac

SEQ ID NO: 32030 - DNA, 5307 bp, Homo sapiens
agtccctatttggaactgctctcgcggcagttcagacctcgtgctcgtccccttcgcctgtctgtgtgtggtatccgtaggtccggggcacttttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagaggagttcagcttctaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggcttttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgctttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggtt

SEQ ID NO: 32031 - DNA, 5322 bp, Homo sapiens
agtccctatttggaactgctctcgcggcagttcagacctcgtgctcgtccccttcgcctgtctgtgtgtggtatccgtaggtccggggcacttttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggcttttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgctttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggtt

SEQ ID NO: 32032 - DNA, 2295 bp, Homo sapiens
atgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaa

SEQ ID NO: 32033 - DNA, 6004 bp, Homo sapiens
tataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcacttttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgataggtataatggcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggcttttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgctttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctccccccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcgaaa

SEQ ID NO: 32034 - DNA, 2918 bp, Homo sapiens
aattccgcgcgagtggcgcggggggctgcttgtgttccagggggagctgttcacgcggtccccggccccgctctgaagtctcccaactcacccggcttgtctcccgcccccgccttactggggagagggaggcccttggtgaaaggcatgggagccccgctgccgacggggagagatggggcgccccccctccgccccgtcggagagctgagaaacttgctgggaaggttctgggctgagggtggcctcttttggttgggcgccgttggggaggggccggggccgctctgagcgcggtctcatgcccccgccccctcccctgtcttgtcttcgcgggctccaggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgataggtataatggcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacaga

SEQ ID NO: 32035 - DNA, 3021 bp, Homo sapiens
cattttgcttgttgctacctttatggtgtgtgtgtttgtgtgtgtgctctcacacaaagggggatgcggccggggggcgccgttgagagaggaggttaattccgcgcgagtggcgcggggggctgcttgtgttccagggggagctgttcacgcggtccccggccccgctctgaagtctcccaactcacccggcttgtctcccgcccccgccttactggggagagggaggcccttggtgaaaggcatgggagccccgctgccgacggggagagatggggcgccccccctccgccccgtcggagagctgagaaacttgctgggaaggttctgggctgagggtggcctcttttggttgggcgccgttggggaggggccggggccgctctgagcgcggtctcatgcccccgccccctcccctgtcttgtcttcgcgggctccaggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacaga

SEQ ID NO: 32036 - DNA, 1977 bp, Homo sapiens
agtttcctcttggcctgaacttggctgacctccgcagcttccgcccgactctggctaaagtcttggaggctactgccttgaagatgacctctagggaccagcccagacccaagggccccccgaaaagcacttcgccttgtcctgggatctcgaactctgagagctctccgacgctgaattatcagggcattctaaatcggctcaagcagttccccaggttttctcctcattttgctgcggagttggagagcatttactactcgctgcacaagatccagcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttggcacgacactctgaccgagcaactctggcggatttttgccggcgtccacgatgagaaggcaaagcccagagacagacagcaggcaccaggcctggggcaggaaagcaaggcaccaggatcctgtgacccaggaacagacccatgtcctgaagatgcctccacccccaggccacctgaggcctcctccagtccccctgagggttcccaagacaggaacacaagttggggtgtggtccaggagcctcctggaagagcctctcggtttctacagtccatatcctgggaccctgaggactttgaagatgcatggaagaggccagatgccttgcccgggcagtcaaagagactcgccgtcccgtgcaaactggaaaagatgcggatcttggcacacggggagctcgtgctcgccacggccatcagcagcttcacgcggcacgtgttcacctgtggcagaagaggcatcaaggtgtggagcctgactggacaggtggctgaggacaggttccctgagagccacctgcctatacagacccctggggccttcctgcgcacctgcctgctgtcctcaaacagcaggagcctgctcaccggtggctacaacctggccagcgtgagcgtgtgggacctggcggcgccctccctgcatgtgaaggagcagttgccctgtgcaggtctcaactgccaggccctggatgccaacctggatgccaacctggccttcgccagcttcaccagtggtgtggtcaggatctgggacctgcgggatcagagtgtggtcagggacctcaagggttatcctgatggagtcaagagtatcgtggtcaagggctacaacatctggactgggggtccggatgcctgtctgcggtgctgggaccagaggaccatcatgaaacctctggagtaccaattcaagtctcagataatgagcctgtcccacagcccccaggaggactgggtgctgctgggcatggccaatggccagcagtggctgcaaagcaccagcgggagccagcggcacatggtggggcaaaaagacagcgtcatcctgagcgtcaagttctccccctttggccagtggtgggcaagcgttggaatggacgacttccttggcgtctacagcatgccggcggggacaaaagtgttcgaggtgcctgagatgtctccagtcacgtgctgtgacgtctcttccaacaaccgcctcgttgtcacaggctccggggagcacgcctccgtgtaccagatcacctactgaggggcctcgctgctgtcatcccactccggctcctcttttcatccccccccttccccccccccaacaagggggacatggtggagggaagcgggaaggctcttctgtggcatcgcacgatctagtctgtggtgtagactggtcgccatcacgtgtaataaagcacccgggaaaggca

SEQ ID NO: 32037 - DNA, 1880 bp, Homo sapiens
gaacttggctgacctccgcagcttccgcccggtgagggacccttgtcctgggatctcgaactctgagagctctccgacgctgaattatcagggcattctaaatcggctcaagcagttccccaggttttctcctcattttgctgcggagttggagagcatttactactcgctgcacaagatccagcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttggcacgacactctgaccgagcaactctggcggatttttgccggcgtccacgatgagaaggcaaagcccagagacagacagcaggcaccaggcctggggcaggaaagcaaggcaccaggatcctgtgacccaggaacagacccatgtcctgaagatgcctccacccccaggccacctgaggcctcctccagtccccctgagggttcccaagacaggaacacaagttggggtgtggtccaggagcctcctggaagagcctctcggtttctacagtccatatcctgggaccctgaggactttgaagatgcatggaagaggccagatgccttgcccgggcagtcaaagagactcgccgtcccgtgcaaactggaaaagatgcggatcttggcacacggggagctcgtgctcgccacggccatcagcagcttcacgcggcacgtgttcacctgtggcagaagaggcatcaaggtgtggagcctgactggacaggtggctgaggacaggttccctgagagccacctgcctatacagacccctggggccttcctgcgcacctgcctgctgtcctcaaacagcaggagcctgctcaccggtggctacaacctggccagcgtgagcgtgtgggacctggcggcgccctccctgcatgtgaaggagcagttgccctgtgcaggtctcaactgccaggccctggatgccaacctggatgccaacctggccttcgccagcttcaccagtggtgtggtcaggatctgggacctgcgggatcagagtgtggtcagggacctcaagggttatcctgatggagtcaagagtatcgtggtcaagggctacaacatctggactgggggtccggatgcctgtctgcggtgctgggaccagaggaccatcatgaaacctctggagtaccaattcaagtctcagataatgagcctgtcccacagcccccaggaggactgggtgctgctgggcatggccaatggccagcagtggctgcaaagcaccagcgggagccagcggcacatggtggggcaaagacagcgtcatcctgagcgtcaagttctccccctttggccagtggtgggcaagcgttggaatggacgacttccttggcgtctacagcatgccggcggggacaaaagtgttcgaggtgcctgagatgtctccagtcacgtgctgtgacgtctcttccaacaaccgcctcgttgtcacaggctccggggagcacgcctccgtgtaccagatcacctactgaggggcctcgctgctgtcatcccactccggctcctcttttcatccccccccttccccccccccaacaagggggacatggtggagggaagcgggaaggctcttctgtggcatcgcacgatctagtctgtggtgtagactggtcgccatcacgtgtaataaagcacccgggaaaggc

SEQ ID NO: 32038 - DNA, 2039 bp, Homo sapiens
attgatctgcttcgcggtccaggtggcggctgggtggggcctgggcgggacggggcggggacaaggcgggacgaggcggggcccgatgggtcaaatggcccccggtgggggaaggaggagtttcctcttggcctgaacttggctgacctccgcagcttccgcccgactctggctaaagtcttggaggctactgccttgaagatgacctctagggaccagcccagacccaagggccccccgaaaagcacttcgccttgtcctgggatctcgaactctgagagctctccgacgctgaattatcagggcattctaaatcggctcaagcagttccccaggttttctcctcattttgctgcggagttggagagcatttactactcgctgcacaagatccagcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttggcacgacactctgaccgagcaactctggcggatttttgccggcgtccacgatgagaaggcaaagcccagagacagacacttttccattttccaggggcaggaaagcaaggcaccaggatcctgtgacccaggaacagacccatgtcctgaagatgcctccacccccaggccacctgaggcctcctccagtccccctgagggttcccaagacaggaacacaagttggggtgtggtccaggagcctcctggaagagcctctcggtttctacagtccatatcctgggaccctgaggactttgaagatgcatggaagaggccagatgccttgcccgggcagtcaaagagactcgccgtcccgtgcaaactggaaaagatgcggatcttggcacacggggagctcgtgctcgccacggccatcagcagcttcacgcggcacgtgttcacctgtggcagaagaggcatcaaggtgtggagcctgactggacaggtggctgaggacaggttccctgagagccacctgcctatacagacccctggggccttcctgcgcacctgcctgctgtcctcaaacagcaggagcctgctcaccggtggctacaacctggccagcgtgagcgtgtgggacctggcggcgccctccctgcatgtgaaggagcagttgccctgtgcaggtctcaactgccaggccctggatgccaacctggatgccaacctggccttcgccagcttcaccagtggtgtggtcaggatctgggacctgcgggatcagagtgtggtcagggacctcaagggttatcctgatggagtcaagagtatcgtggtcaagggctacaacatctggactgggggtccggatgcctgtctgcggtgctgggaccagaggaccatcatgaaacctctggagtaccaattcaagtctcagataatgagcctgtcccacagcccccaggaggactgggtgctgctgggcatggccaatggccagcagtggctgcaaagcaccagcgggagccagcggcacatggtggggcaaaaagacagcgtcatcctgagcgtcaagttctccccctttggccagtggtgggcaagcgttggaatggacgacttccttggcgtctacagcatgccggcggggacaaaagtgttcgaggtgcctgagatgtctccagtcacgtgctgtgacgtctcttccaacaaccgcctcgttgtcacaggctccggggagcacgcctccgtgtaccagatcacctactgaggggcctcgctgctgtcatcccactccggctcctcttttcatccccccccttccccccccccaacaagggggacatggtggagggaagcgggaaggctcttctgtggcatcgcacgatc

SEQ ID NO: 32039 - DNA, 1883 bp, Homo sapiens
gaacttggctgacctccgcagcttccgcccggtgagggacccttgtcctgggatctcgaactctgagagctctccgacgctgaattatcagggcattctaaatcggctcaagcagttccccaggttttctcctcattttgctgcggagttggagagcatttactactcgctgcacaagatccagcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttggcacgacactctgaccgagcaactctggcggatttttgccggcgtccacgatgagaaggcaaagcccagagacagacagcaggcaccaggcctggggcaggaaagcaaggcaccaggatcctgtgacccaggaacagacccatgtcctgaagatgcctccacccccaggccacctgaggcctcctccagtccccctgagggttcccaagacaggaacacaagttggggtgtggtccaggagcctcctggaagagcctctcggtttctacagtccatatcctgggaccctgaggactttgaagatgcatggaagaggccagatgccttgcccgggcagtcaaagagactcgccgtcccgtgcaaactggaaaagatgcggatcttggcacacggggagctcgtgctcgccacggccatcagcagcttcacgcggcacgtgttcacctgtggcagaagaggcatcaaggtgtggagcctgactggacaggtggctgaggacaggttccctgagagccacctgcctatacagacccctggggccttcctgcgcacctgcctgctgtcctcaaacagcaggagcctgctcaccggtggctacaacctggccagcgtgagcgtgtgggacctggcggcgccctccctgcatgtgaaggagcagttgccctgtgcaggtctcaactgccaggccctggatgccaacctggatgccaacctggccttcgccagcttcaccagtggtgtggtcaggatctgggacctgcgggatcagagtgtggtcagggacctcaagggttatcctgatggagtcaagagtatcgtggtcaagggctacaacatctggactgggggtccggatgcctgtctgcggtgctgggaccagaggaccatcatgaaacctctggagtaccaattcaagtctcagataatgagcctgtcccacagcccccaggaggactgggtgctgctgggcatggccaatggccagcagtggctgcaaagcaccagcgggagccagcggcacatggtggggcaaaaagacagcgtcatcctgagcgtcaagttctccccctttggccagtggtgggcaagcgttggaatggacgacttccttggcgtctacagcatgccggcggggacaaaagtgttcgaggtgcctgagatgtctccagtcacgtgctgtgacgtctcttccaacaaccgcctcgttgtcacaggctccggggagcacgcctccgtgtaccagatcacctactgaggggcctcgctgctgtcatcccactccggctcctcttttcatccccccccttccccccccccaacaagggggacatggtggagggaagcgggaaggctcttctgtggcatcgcacgatctagtctgtggtgtagactggtcgccatcacgtgtaataaagcacccgggaaaggca

SEQ ID NO: 32040 - DNA, 2143 bp, Homo sapiens
acagaagcgagtccgactgtgctcgctgctcagcgccgcacccggaagatgaggctcgccgtgggagccctgctggtctgcgccgtcctgggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctatagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttc

SEQ ID NO: 32041 - DNA, 2968 bp, Homo sapiens
gggctttgcctgtcattctgcagttctagtgtggggtctgggcgcagttcttttccctctccagcctcggagtcttcctctgtggactgcgcagataggactggtggcacggaccagctctgcagccctggagtcaggagcagagccccccggctcccagcccgccgtagccgctcctggcaccgagcgagccgcgatgacaatggctgcattgtgcttcatgtcccttcccatcaacatttctgtgctggactccttccactcgcgggtcgtctccagagctcagaaaatgaggtgatcagtgggacgagtaaggaaggggggttgggagaggggcgattgggcaacccggctgcacaaacacgggaggtcaaagattgcgcccagcccgcccaggccgggaatggaataaagggacgcggggcgccggaggctgcacagaagcgagtccgactgtgctcgctgctcagcgccgcacccggaagatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctatagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaaactccattctttcctaaatattttcaacaaaggatttctttatgcattctgcctaaatacctatgcaactgagcccttccttctcagctcaagattcgtctggtctttccctacagctttgtgtgtgccatggccacatctcctgggtacagttcaaggagacatcttttctaaaagggtctgcgtgatcattaaaatataatcaaatgta

SEQ ID NO: 32042 - DNA, 5111 bp, Homo sapiens
ctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactga

SEQ ID NO: 32043 - DNA, 5032 bp, Homo sapiens
agagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggata

SEQ ID NO: 32044 - DNA, 2137 bp, Homo sapiens
cagagcgtcgggatatcgggtggcggctcgggacggaggacgcgctagtgttcttctgtgtggcagttcagaatgatggatcaagctagatcagcattctctaacttggctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttc

SEQ ID NO: 32045 - DNA, 4809 bp, Homo sapiens
agagcgtcgggatatcgggtggcggctcgggacggaggacgcgctagtgttcttctgtgtggcagttcagaatgatggatcaagctagatcagcattctctaacttggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactg

SEQ ID NO: 32046 - DNA, 12590 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccaggcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtt

SEQ ID NO: 32047 - DNA, 12677 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaagcatttccgagtgcgggagatgtcccttgtctccattctgtcagtttgaggaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccagggtaaaccgacctggtccggcatgcattcatcatcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtt

SEQ ID NO: 32048 - DNA, 550 bp, Homo sapiens
aggcctctctccatccagttttgatggaggtagctctgcctgccatgtggatccagcctcggagggtctcggtccatctccagccgtcaccttcccaaagaccctcctggcctcctctccattctgcgggccgagaagaaccccaggagagcagcggggaccgggagcgaggagtgggggtggcaaaccctaccctgcctgccaccttcagtccagtggtggacaatacctggaccccatagctgccaactcgggaagccgcgcccccccccaggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatt

SEQ ID NO: 32049 - DNA, 288 bp, Homo sapiens
gagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggttaatgttgaagaaggaaaatgcggaagtcgtcatttgacaagttttataaatgagtatttgaagctcaggaataagtgaagctgaaatttgaaaaaa

SEQ ID NO: 32050 - DNA, 976 bp, Homo sapiens
agagcgaggaggggcgaggccaagaaagcgcgcgtttctgggaggggaggagcctggctaaggagcgccgcgtcacatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaa

SEQ ID NO: 32051 - DNA, 2952 bp, Homo sapiens
gtgcgggacgcgctgcagctggagaggaaaggcagagcgaggaggggcgaggccaagaaagcgcgcgtttctgggaggggaggagcctggctaaggagcgccgcgtcacatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaatgttggtgcagctgttcacaaagaagtgttcttgttctattataattagagttcttctgtagtttaatcgttagggcagtgtgttccttgggctgaggtgtatctttgctattttgggctgggttgagggggggatgaatttctgtattcctggaaaattcagagtgcataactaggtattagagtgatctccatttggggatggagttacagtaaataactagactgcgggtactttaatacatgttcttattattttgcatttaagtaattttcatgaccaattgtagggatgttgctacaggtgggttattttgttgccttgctaacctttatcgcatctaggtattagtatgtttcaggtactttgggaagaactttacatataatctttagcaatgaaatgatgtagagtaacttaccttagttcaaatagctgtttaagtggcaatgccacgatctgaattgaacctaggtgatcttagtccacagttctcttgatcatgatgtctcaaatctgggtacctgggtgatggaaaataccagtaatggagcataggcagtattggcaggtcttaatttgtaaaacttactgtccagggtgttttcagtgtttgccaacttgtggtaaattaatatgcttagagaactacccttaggtttgtttctgataagcatgtggaaacaacttagtatatgcctgatgggttatttcaaattgttctcaatgagttttgaaacaagaatttgtagtatttatatataaagttgagttttagggtgtggtcccagagggggttgtgttatggatggatacattaaaggctgagaaacctgg

SEQ ID NO: 32052 - DNA, 4310 bp, Homo sapiens
gtcagctgtgccccggtcgccgagtggcgaggaggtgacggtagccgccttcctatttccgcccggcgggcagcgctgcggggcgagtgccagcagagaggcgctcggtcctccctccgccctcccgcgccgggggcaggccctgcctagtctgcgtctttttcccccgcaccgcggcgccgctccgccactcgggcaccgcaggtagggcaggaggctggagagcctgctgcccgcccgcccgtaaaatggtcccctcggctggacagctcgccctgttcgctctgggtattgtgttggctgcgtgccaggccttggagaacagcacgtccccgctgagtgcagacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaagaaatcagcggaccacgatttcaagacttgttaaaaaagaactgcaaagagacggactcctgttcacctaggtgaggtgtgtgcagcagttggtgtctgagtccacatgtgtgcagttgtcttctgccagccatggattccaggctatatatttctttttaatgggccacctccccacaacagaattctgcccaacacaggagatttctatagttattgttttctgtcatttgcctactggggaagaaagtgaaggaggggaaactgtttaatatcacatgaagaccctagctttaagagaagctgtatcctctaaccacgagaccctcaaccagcccaacatcttccatggacacatgacattgaagaccatcccaagctatcgccacccttggagatgatgtcttatttattagatggataatggttttatttttaatctcttaagtcaatgtaaaaagtataaaaccccttcagacttctacattaatgatgtatgtgttgctgactgaaaagctatactgattagaaatgtctggcctcttcaagacagctaaggcttgggaaaagtcttccagggtgcggagatggaaccagaggctgggttactggtaggaataaaggtaggggttcagaaatggtgccattgaagccacaaagccggtaaatgcctcaatacgttctgggagaaaacttagcaaatccatcagcagggatctgtcccctctgttggggagagaggaagagtgtgtgtgtctacacaggataaacccaatacatattgtactgctcagtgattaaatgggttcacttcctcgtgagccctcggtaagtatgtttagaaatagaacattagccacgagccataggcatttcaggccaaatccatgaaagggggaccagtcatttattttccattttgttgcttggttggtttgttgctttatttttaaaaggagaagtttaactttgctatttattttcgagcactaggaaaactattccagtaatttttttttcctcatttccattcaggatgccggctttattaacaaaaactctaacaagtcacctccactatgtgggtcttcctttcccctcaagagaaggagcaattgttcccctgagcatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagcttattacatcgtgaaaggtacatttaaaatatgttaaattggcttgaaattttcagagaattttgtcttcccctaattcttcttccttggtctggaagaacaatttctatgaattttctctttatttttttttataattcagacaattctatgacccgtgtcttcatttttggcactcttatttaacaatgccacacctgaagcacttggatctgttcagagctgaccccctagcaacgtagttgacacagctccaggtttttaaattactaaaataagttcaagtttacatcccttgggccagatatgtgggttgaggcttgactgtagcatcctgcttagagaccaatcaacggacactggtttttagacctctatcaatcagtagttagcatccaagagactttgcagaggcgtaggaatgaggctggacagatggcggaagcagaggttccctgcgaagacttgagatttagtgtctgtgaatgttctagttcctaggtccagcaagtcacacctgccagtgccctcatccttatgcctgtaacacacatgcagtgagaggcctcacatatacgcctccctagaagtgccttccaagtcagtcctttggaaaccagcaggtctgaaaaagaggctgcatcaatgcaagcctggttggaccattgtccatgcctcaggatagaacagcctggcttatttggggatttttcttctagaaatcaaatgactgataagcattggatccctctgccatttaatggcaatggtagtctttggttagctgcaaaaatactccatttcaagttaaaaatgcatcttctaatccatctctgcaagctccctgtgtttccttgccctttagaaaatgaattgttcactacaattagagaatcatttaacatcctgacctggtaagctgccacacacctggcagtggggagcatcgctgtttccaatggctcaggagacaatgaaaagcccccatttaaaaaaataacaaacattttttaaaaggcctccaatactcttatggagcctggatttttcccactgctctacaggctgtgactttttttaagcatcctgacaggaaatgttttcttctacatggaaagatagacagcagccaaccctgatctggaagacagggccccggctggacacacgtggaaccaagccagggatgggctggccattgtgtccccgcaggagagatgggcagaatggccctagagttcttttccctgagaaaggagaaaaagatgggattgccactcacccacccacactggtaagggaggagaatttgtgcttctggagcttctcaagggattgtgttttgcaggtacagaaaactgcctgttatcttcaagccaggttttcgagggcacatgggtcaccagttgctttttcagtcaatttggccgggatggactaatgaggctctaacactgctcaggagacccctgccctctagttggttctgggctttgatctcttccaacctgcccagtcacagaaggaggaatgactcaaatgcccaaaaccaagaacacattgcagaagtaagacaaacatgtatatttttaaatgttctaacataagacctgttctctctagccattgatttaccaggctttctgaaagatctagtggttcacacagagagagagagagtactgaaaaagcaactcctcttcttagtcttaataatttactaaaatggtcaacttttcattatctttattataataaacctgatgcttttttttagaactccttactctgatgtctgtatatgttgcactgaaaaggttaatatttaatgttttaatttattttgtgtggtaagttaattttgatttctgtaatgtgttaatgtgattagcagttattttccttaatatctgaattatacttaaagagtagtgagcaatataagacgcaattgtgtttttcagtaatgtgcattgttattgagttgtactgtaccttatttggaaggatgaaggaatgaatctttttttcctaaatcaa

SEQ ID NO: 32053 - DNA, 1225 bp, Homo sapiens
actcgggcaccgcaggtagggcaggaggctggagagcctgctgcccgcccgcccgtaaaatggtcccctcggctggacagctcgccctgttcgctctgggtattgtgttggctgcgtgccaggccttggagaacagcacgtccccgctgagtgacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaagaaatcagcggaccacgatttcaagacttgttaaaaaagaactgcaaagagacggactcctgttcacctaggtgaggtgtgtgcagcagttggtgtctgagtccacatgtgtgcagttgtcttctgccagccatggattccaggctatatatttctttttaatgggccacctccccacaacagaattctgcccaacacaggagatttctatagttattgttttctgtcatttgcctactggggaagaaagtgaaggaggggaaactgtttaatatcacatgaagaccctagctttaagagaagctgtatcctctaaccacgagaccctcaaccagcccaacatcttccatggacacatgacattgaagaccatcccaagctatcgccacccttggagatgatgtcttatttattagatggataatggttttatttttaatctcttaagtcaatgtaaaaagtataaaaccccttcagacttcta

SEQ ID NO: 32054 - DNA, 2901 bp, Homo sapiens
cagcagatcagccagtagacatgatgagcatcaaagcctttacgcttgtctctgctgtggagcgggagctgctgatgggcgacaaggagcgcgtcaacatagagtgcgtggagtgctgcggcagggacctctacgtgggcaccaacgactgcttcgtctaccacttcctgttggaggagaggccagtgcctgctgggccagccacgttcactgccaccaaacagctgcagagacacttgggcttcaagaagcccgtgaacgagctgcgtgcggcctcagcactcaacaggctgctggtgctgtgtgacaactccatcagcctggtcaacatgctgaacctcgagccagtgccttcgggggcccgcatcaagggggcagccacgtttgcactgaacgagaaccctgtgagtggggaccccttctgtgtagaagtttgcatcatctctgtcaaacgcagaaccatccagatgtttctggtgtacgaggaccgggtgcagatcgtcaaggaggtgtcgactgccgagcagcccctcgctgtggctgtggacggccacttcctgtgtctggctctgaccactcagtacatcatccacaattacagcacaggcgtctcccaggacctgtttccctactgcagtgaggagaggccgccgatcgtcaagaggatagggagacaggagttcctgctggcgggccccggagggctgggcatgtttgccacagtcgcagggatatcccagcgcgcccccgtgcactggtcggagaatgtgattggggcggctgtgtcctttccatacgtcatagcgctcgatgacgaattcatcacagtccacagcatgttggatcagcaacagaagcagacgctgccctttaaggagggccatatcctacaggactttgaaggaagagtgatcgttgccacaagtaaaggagtttacatcttggttccattacctttggaaaaacaaatacaggatcttctagcaagccgcagagtagaagaggctttggttttagcaaaaggagcccggaggaacattccaaaggaaaaatttcaggtaatgtacagaaggattctgcagcaggcgggatttatacagtttgcacaacttcagttcctggaagctaaagagctcttcagaagcggccagcttgatgtccgggagctgatctctctctaccccttcctgttgcccacctcctcctccttcacccggtcccaccctcctcttcatgagtacgcagacctgaaccagctgacccagggggaccaggagaagatggccaagtgcaaacgcttcctcatgagctacctgaacgaggtccgcagcacagaggtagcaaatggctacaaggaggacatcgacacagccttgctcaaactgtatgcagaggctgaccacgacagcctgctggacctcctggtcactgagaacttctgtcttctgacggacagtgctgcctggctagagaagcacaaaaagtattttgcacttggactgctctatcattataataaccaagatgctgctgcagttcagttgtgggtgaacattgtgaatggcgatgtccaggactccacacgctcagacctgtatgaatacatcgtggattttcttacctactgcttagacgaggaactagtgtgggcctatgctgattgggtcctgcagaaaagtgaagaggtcggagttcaggttttcaccaagagacctttggatgaacagcagaagaacagttttaatccagacgacattatcaattgccttaaaaaataccctaaagcccttgtgaagtatctggaacatcttgtgatagacaagagactgcagaaagaagagtatcacacccacttagctgtgctgtacctggaagaggtgctgctgcagagggcctccgccagtggcaagggtgcagaggccaccgagacgcaggccaagctgcggcggctgctccagaaatctgatttataccgagtccactttcttctcgagaggctgcagggagctggcctgcccatggagagcgccatcctgcacgggaagctgggcgagcatgagaaggcgctgcatatcctggtgcacgagctgcaggactttgcagcggccgaggactactgcctgtggtgctccgagggccgagacccaccccaccgccagcaactctttcacacgctgctggccatctacctgcatgctggccccactgcccacgagctggccgtggctgccgtggacctgctgaaccgccacgccaccgaatttgatgcagcccaggtgctgcagatgctgcctgacacctggtcagtgcagctcctctgcccattcctgatgggggccatgagggacagcatccatgccaggaggaccatgcaggtggctctcggcctggccaggtccgaaaacttaatctacacctacgataagatgaagttgaaaggaagctcaatccaactctcagacaaaaagctttgtcagatatgccaaaatcccttttgtgagcctgtgtttgttagatacccaaatggtggtcttgtgcacacccactgtgccgccagcagacacacaaaccccagctcatccagtcctggcactcggacttgaaaagcttggcccaagggtgcgaggggaactccgagttctttctgagcctgctggacatgaagagcagatgaccaccatgctctgtgtcagccaggacgaagggagacatctgggtgccagggagccttccgtccatacgcaacaaggactcctcgctgctgaccaggctctatgaatgtacatggaatgaccaggctctatgaatgtacatggaaaacccctaaaaatccccaaaacagaaacatacaagagttcacctgtccaggtacatagtaatccaagacagaggtctactttg

SEQ ID NO: 32055 - DNA, 5979 bp, Homo sapiens
cccgcagcggcgggggcggagaagagacctcagccccgcgggctcgcacagctggcgcggaccacgctctcgcccggggccggcggcctcagcgccccccgaatgaacaccttccgcccgctggccgccccgcgaggcgggccgtgtcgtggccccggtgcacggagggggacgccgaggcccggagcagggcccgtctcggcctgtgctcggagccaggcggcagggcccgcgggccggcgggcggcgcggagacggctgcgctcccgccctccgccagcgcctggcggccgccccacgtgacgggaagcggcggctgcggggtcgggccagcccaggagccgcgggccggagcggggcggcggggccccaggccgcggggcggcgcgggacggcgggcgccggcgccgcagatcagccagtagacatgatgagcatcaaagcctttacgcttgtctctgctgtggagcgggagctgctgatgggcgacaaggagcgcgtcaacatagagtgcgtggagtgctgcggcagggacctctacgtgggcaccaacgactgcttcgtctaccacttcctgttggaggagaggccagtgcctgctgggccagccacgttcactgccaccaaacagctgcagagacacttgggcttcaagaagcccgtgaacgagctgcgtgcggcctcagcactcaacaggctgctggtgctgtgtgacaactccatcagcctggtcaacatgctgaacctcgagccagtgccttcgggggcccgcatcaagggggcagccacgtttgcactgaacgagaaccctgtgagtggggaccccttctgtgtagaagtttgcatcatctctgtcaaacgcagaaccatccagatgtttctggtgtacgaggaccgggtgcagatcgtcaaggaggtgtcgactgccgagcagcccctcgctgtggctgtggacggccacttcctgtgtctggctctgaccactcagtacatcatccacaattacagcacaggcgtctcccaggacctgtttccctactgcagtgaggagaggccgccgatcgtcaagaggatagggagacaggagttcctgctggcgggccccggagggctgggcatgtttgccacagtcgcagggatatcccagcgcgcccccgtgcactggtcggagaatgtgattggggcggctgtgtcctttccatacgtcatagcgctcgatgacgaattcatcacagtccacagcatgttggatcagcaacagaagcagacgctgccctttaaggagggccatatcctacaggactttgaaggaagagtgatcgttgccacaagtaaaggagtttacatcttggttccattacctttggaaaaacaaatacaggatcttctagcaagccgcagagtagaagaggctttggttttagcaaaaggagcccggaggaacattccaaaggaaaaatttcaggtaatgtacagaaggattctgcagcaggcgggatttatacagtttgcacaacttcagttcctggaagctaaagagctcttcagaagcggccagcttgatgtccgggagctgatctctctctaccccttcctgttgcccacctcctcctccttcacccggtcccaccctcctcttcatgagtacgcagacctgaaccagctgacccagggggaccaggagaagatggccaagtgcaaacgcttcctcatgagctacctgaacgaggtccgcagcacagaggtagcaaatggctacaaggaggacatcgacacagccttgctcaaactgtatgcagaggctgaccacgacagcctgctggacctcctggtcactgagaacttctgtcttctgacggacagtgctgcctggctagagaagcacaaaaagtattttgcacttggactgctctatcattataataaccaagatgctgctgcagttcagttgtgggtgaacattgtgaatggcgatgtccaggactccacacgctcagacctgtatgaatacatcgtggattttcttacctactgcttagacgaggaactagtgtgggcctatgctgattgggtcctgcagaaaagtgaagaggtcggagttcaggttttcaccaagagacctttggatgaacagcagaagaacagttttaatccagacgacattatcaattgccttaaaaaataccctaaagcccttgtgaagtatctggaacatcttgtgatagacaagagactgcagaaagaagagtatcacacccacttagctgtgctgtacctggaagaggtgctgctgcagagggcctccgccagtggcaagggtgcagaggccaccgagacgcaggccaagctgcggcggctgctccagaaatctgatttataccgagtccactttcttctcgagaggctgcagggagctggcctgcccatggagagcgccatcctgcacgggaagctgggcgagcatgagaaggcgctgcatatcctggtgcacgagctgcaggactttgcagcggccgaggactactgcctgtggtgctccgagggccgagacccaccccaccgccagcaactctttcacacgctgctggccatctacctgcatgctggccccactgcccacgagctggccgtggctgccgtggacctgctgaaccgccacgccaccgaatttgatgcagcccaggtgctgcagatgctgcctgacacctggtcagtgcagctcctctgcccattcctgatgggggccatgagggacagcatccatgccaggaggaccatgcaggtggctctcggcctggccaggtccgaaaacttaatctacacctacgataagatgaagttgaaaggaagctcaatccaactctcagacaaaaagctttgtcagatatgccaaaatcccttttgtgagcctgtgtttgttagatacccaaatggtggtcttgtgcacacccactgtgccgccagcagacacacaaaccccagctcatccagtcctggcactcggacttgaaaagcttggcccaagggtgcgaggggaactccgagttctttctgagcctgctggacatgaagagcagatgaccaccatgctctgtgtcagccaggacgaagggagacatctgggtgccagggagccttccgtccatacgcaacaaggactcctcgctgctgaccaggctctatgaatgtacatggaatgaccaggctctatgaatgtacatggaaaacccctaaaaatccccaaaacagaaacatacaagagttcacctgtccaggtacatagtaatccaagacagaggtctactttgaaaaaaaaaaaaagggagtcttcctcatgcagtccagacccaggtgggggatcccccaccacccccacactccaacctttagactcatgtttgcactggaaacgtggcttcaccatggctggcgacaaagtcctctcttgcctgggtgagtggcgagggcacagagcctcatgggggtcagccttgccctcctgcagaaacacgttctccatccacgccgctcactcatgggcccatttcccagggttacctcgtgggctctgcctttgccctcagaaacggctgaccctggagaagtacctttgttccttctttcttcctctccggctctcagctcccaaaagattctgccttgtgtacccaagcactcactcttgggtgaactaatgcttctggctgcctagcaagtgaagatctgttgagaaactgagaacgctccaagagagaagctgctctcccctccttgaagaagccgcggacacgggaaacccacggcgggcaagggcccagctgtgtgctcctttcctgtcatggcatctgctgatttgaaactccatgacgaacacgttgaactaaacatttttatttaaatttgtatcatgttcgtagttgctctcttgttgagagagtcatctgtcctgtttgttaggggtattttttcttgttaaaatgtatctcctgttgaatactcgggaaattcaaagggaagtgtggtcagcacacactgagcgttcttttctggagaggccggttttagcctcgtacctttagcaggaccgacagcgggtggaagggcccgtgtgctggatgggggtgtcgcctcctggatggcacaccctcccgaggacatccagacaggctgtgtcaccctccagcactttatgtgcctgctctgaggtgtcctgaacacacagcaacggcctctccttcatcacaggccggggattccttttgtgtttctgtataacatcgatgacgagctgaagctgttgtcacttcactgccctctttggaatttcttcattgtgctgactgattctattaggggctaacaataaaggcagtctacccactactatcatgcttgggaaacaagcgtcagcttgtacatatgacaagagaggaccctgaatacaccctctcttcatcagcccaagccttactgaggtgggatgaagacctcattctctgttctttaaaacatgtttcgtgaactaatattggtccatgtattttttgtccttttgggactctaagtgggtcaagaagcaaaaacatccatgtgttgtttggggggaattggcaccattttttcctgactatgtttcaattaactaaagaataaatgatgaagaaattctccttgtagcacaactgtatgctgtgtaaattggtgtgagctcaaagcccagtcatgtgttttacctgtgggtgactctgttgtagaatggtcatattactgcatatgttatcatgacaacttgtgagtttgagtttatatttctcaaagaacaagttacccgtatatgcaacattgcgccattaaaagcttatttctctgtacacaaaatgggtaaaatcttgaaaaaacttagtaatttctcattcctaacacacagacagagtctcactctgtcacccaggctggagtgcagtggcgcaatctcggctcactgcaacctccacctcctgggttcaagcgattctgctgcctcagcctcccgagtagctgggactacaggtgcatgccaccacgcccagctaatttttgtatttttagtagagacggggtttcaccatgttggccaggatggtctcggtctcctgacctcgtgatctgcctgcctcggcctcccaaagtgctgggattacaggcgtgagccactgcgcccagccaacactagtcatttttattttttcactgaacattgatcaatactctaaaatgtttgtcatcctttagaataatgggaattaaagttgagcagttttccatctctaccaaatccttcaccacaagcagcattctattacagtatgaagaattgtctcatatgttaaaactgtacttttctctaacctttctctcactcctacaaggcccttttctcaaatcatatttctgagagaaatgtatggttctttctcacaggcctgctgatttgtaactgtgccatcgaatagagcaattagatccatcagacctttttcccctcattaggttcagtggaaccattctggttaaaacagcatgaactgaactcagtttacattcatattctatgggcaataccatttggtttttggaactgtttatctgctgttccctatcaagtattaatgtagggatgtcactcaggctgcgttgcactgggctgagttcaactgcgacgctctcactgacgcgtgcttacatgtgcttctcacttccggagcacaggcaggtggctgcggggtcccagctctgaatggatgcccatgatgcaactggggcagcccttgctttttgcttgctctcccacagaaacctttgtccttgcaactttatcctttgtcccgattgggtcccagatacacaaaatgtacaaatgtaaacttgctcattttattaaaattcttttagttctttgttctttctgtaattttttaaaataaaaattgccttgatgga

SEQ ID NO: 32056 - DNA, 2006 bp, Homo sapiens
agcagacgctgccctttaaggagggccatatcctacaggactttgaaggaagagtgatcgttgccacaagtaaaggagtttacatcttggttccattacctttggaaaaacaaatacaggatcttctagcaagccgcagagtagaagaggctttggttttagcaaaaggagcccggaggaacattccaaaggaaaaatttcaggtaatgtacagaaggattctgcagcaggcgggatttatacagtttgcacaacttcagttcctggaagctaaagagctcttcagaagcggccagcttgatgtccgggagctgatctctctctaccccttcctgttgcccacctcctcctccttcacccggtcccaccctcctcttcatgagtacgcagacctgaaccagctgacccagggggaccaggagaagatggccaagtgcaaacgcttcctcatgagctacctgaacgaggtccgcagcacagaggtagcaaatggctacaaggaggacatcgacacagccttgctcaaactgtatgcagaggctgaccacgacagcctgctggacctcctggtcactgagaacttctgtcttctgacggacagtgctgcctggctagagaagcacaaaaagtattttgcacttggactgctctatcattataataaccaagatgctgctgcagttcagttgtgggtgaacattgtgaatggcgatgtccaggactccacacgctcagacctgtatgaatacatcgtggattttcttacctactgcttagacgaggaactagtgtgggcctatgctgattgggtcctgcagaaaagtgaagaggtcggttcaggttttcaccaagagacctttggatgaacagcagaagaacagttttaatccagacgacattatcaattgccttaaaaaataccctaaagcccttgtgaagtatctggaacatcttgtgatagacaagagactgcagaaagaagagtatcacacccacttagctgtgctgtacctggaagaggtgctgctgcagagggcctccgccagtggcaagggtgcagaggccaccgagacgcaggccaagctgcggcggctgctccagaaatctgatttataccgagtccactttcttctcgagaggctgcagggagctggcctgcccatggagagcgccatcctgcacgggaagctgggcgagcatgagaaggcgctgcatatcctggtgcacgagctgcaggactttgcagcggccgaggactactgcctgtggtgctccgagggccgagacccaccccaccgccagcaactctttcacacgctgctggccatctacctgcatgctggccccactgcccacgagctggccgtggctgccgtggacctgctgaaccgccacgccaccgaatttgatgcagcccaggtgctgcagatgctgcctgacacctggtcagtgcagctcctctgcccattcctgatgggggccatgagggacagcatccatgccaggaggaccatgcaggtggctctcggcctggccaggtccgaaaacttaatctacacctacgataagatgaagttgaaaggaagctcaatccaactctcagacaaaaagctttgtcagatatgccaaaatcccttttgtgagcctgtgtttgttagatacccaaatggtggtcttgtgcacacccactgtgccgccagcagacacacaaaccccagctcatccagtcctggcactcggacttgaaaagcttggcccaagggtgcgaggggaactccgagttctttctgagcctgctggacatgaagagcagatgaccaccatgctctgtgtcagccaggacgaagggagacatctgggtgccagggagccttccgtccatacgcaacaaggactcctcgctgctgaccaggctctatgaatgtacatggaaaatccccaaaacagaaacatacaagagttcacctgtccaggtacatagtaatccaagacagaggtctactttg

SEQ ID NO: 32057 - DNA, 4621 bp, Homo sapiens
ggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagcatcctgcctcctgttcccattcctag

SEQ ID NO: 32058 - DNA, 4605 bp, Homo sapiens
actcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggatgtggaaatggaggcccagaaagatgaaatcatctgccccagctgtaataggactgcccatccactgagacatattaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagcatcctgcctcctgttcccattcctagtagctaaa

SEQ ID NO: 32059 - DNA, 2385 bp, Homo sapiens
actcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggatgtggaaatggaggcccagaaagatgaaatcatctgccccagctgtaataggactgcccatccactgagacatattaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaaggtagatgtaaaatcagacatataggttcaaacaatcgattgcaaaggagcacttgtcaaaacactggctgggaatctgctcatgtgatgaagaccccagggtttagagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtg

SEQ ID NO: 32060 - DNA, 2013 bp, Homo sapiens
ttatttcccctgtagcttttctcaagagacttcatggactaatttcccaataatcatagtagctaccacttattgaggtcttgctactgcacggatcatgctgagtacttcaggtgtattaaccctcaaaacaactttagaagatgtggaaatggaggcccagaaagatgaaatcatctgccccagctgtaataggactgcccatccactgagacatattaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaa

SEQ ID NO: 32061 - DNA, 6416 bp, Homo sapiens
gattgctgtggcgtcctgcccgtccccgcccgcgtgtgtgcgagggagggcgagtgcgccgggtcggcctgatgggggtaatcgagggtttcggggacgccgagcggcactttcctcttcccagcgagtgaaggagggcagtcggcggctctcgcgccccggccactttccctgcgcgattcccggagctccctgcaggaggtgagagtccccagcgggtccggatggcgtagttttgccgcggcgcagcagctgccggagctcgccgccgccgagcgctgggcggggaaacttgccgccgctttcctccaacttgctgcgggtggatctccgctggacacaccgcctccgaggcagtttgaaaattgcaaggagggactttaagactacttctgatttgcaaagattgtctgtgctctgagcaggctgaagtgactggacgagacgcactgttggagaaataaaaatgacttcccattatgtgattgccatctttgccctgatgagctcctgtttagccactgcaggtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcaggccaggggcctggccagctacagagagaggtcacacttcacctgaatcccatctcctcagtccacatccaccacaagtctgttgtgttcctgctcaactccccacaccccctggtgtggcatctgaagacagagagacttgccactggggtctccagactgtttttggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaactcaagatagcaagaaacatttatattaaagtgggggaagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatgcagaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccattgtgatacaggttccagcccttggggacagtagtggttggccagatggttatgaagatctggagtcaggtgataatggatttccgggagatatggatgaaggagatgcttccctgttcacccgacctgaaatcgtggtgtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtatctgttactaaggctgaacaagaactgggatttgccatccaaacgtgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttcaacacctcactgctctttctacagtgtgagctgacgctgtgtacgaagatggagaagcacccccagaagttgcctaagtgtgtgcctcctgacgaagcctgcacctcgctggacgcctcgataatctgggccatgatgcagaataagaagacgttcactaagccccttgctgtgatccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacaggggagacagcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggcaggaccaatggctgagcctcgtgtccagactcagagggctggattttggttcccttgtaaagacagagtgaatttcagtataaagatcacccgttgtattcaccccacacccagggctagtataaacatgaccctgggcttctgtaccacactagaattcatgtgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatagtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgccctcagggactgcaccctgacaagtgttaaggcaacattcctttcttgtgccctgggccaaaaccaatgctgatgaccttatcagcttcctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcagttataaagtcaaggacgaatttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaaataggccctttcataaaaaccaaactgtagcaagatgcaaatgcatggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctccttgttaaaaaaaaaaaaaaaaaaaaagaatgccaggggggaattatcatgctaaattattttactgctgaagatagcttcattgcaaattattctttttccagaatttcccccaaacaacttagaattccataagtagaacaagatagattctacccccaaaatattcataagcaaatcccactgcccttaaaataaggaagttatgcctggttgtctgtgaatggaacctcagtaggtaatcctgatgaagcttaaaaccttagggcagtgtctacatgggaaacaagtatgtggaaattgacaatcatttttaccaaatcgttgagtaataatatgacttacctgatagatatacacattcaataaggaacatttttttttttcaataaggaacattttaactaaaacattactttagggctgagatttccaggctatctacattgatctactgaaaaatttctagatttccatatacaaacgaagaagacatgagtttagagaatttttttcctttaatttttttttaacagaagggtatcagagtggaggacctagattacgctacctgtgtttgaaaatattgcgctttgcctaaccttcggtggaatgtattgtttcagcatattctatgtataaaaaagtttaaagatgtcttcaaagaagactagagtctttaagtcacttatagctatattttactacaaaatttgtgtataaagatatatttaagtgttttagataaatttaagttactccatatgaaatgtttaatttcagctactgtgaattctttcgatcagtcctttgcttttttaaaaaatcttttccatcgtgttaaaaagaaaattagctattaggagatattaaaagattgatgtcttagaaggacagggttaaaaccttctgtaatatatttaaatatatatttttaagagagatgctacattgccaatgattttataaataatttaaaattaatttacaaatttatagatgcaaaccaaaagatctttttaaaagagagagagaggaaaaaaatcaccttttatttgtttgggtctcattgtcagaattattattcagatcaagaaatctgtgtcgataaaacctaatctcatattggagagtgaatgtcgttaagtatttctgaaatgtttctaaaaaatgaacatgaaaaaaataaggtattttctccctagcttctcattacagtatttctaattgcttcacactttacagttttaatacaaagtacaagctctacttttataacgtgtactacaagtttctttaaaagtattgttgtatttcagctgaactcttgtatctgcagtcttttgttatttctgcaggctacacccttaatttgcagaggccattttgttgtttgtttgatgctgaagctgttgttaaaatgccccaaactccaaggcagattgtctgtataatacgctatagcttttcaccatgtggtgtttaccagctgttactctgtattttaaaaagccagagatttcttctgtctaaactgtttctatagcattttctaaacaaaaaaaatggtttttttctttgccttgtaataagattgtaaatccatttcctgcttgtgttcttagtgggcatgattgtgagtgtgtgtggggtgctcacacgcgtgccagtctttttgtactgtaactacctcatggtttgaatgatgattgtactgctggttgtgttaacagagcacattttgttgggtgagtcctatgtgatttttttcatgtttgttttatctgggggttgttcatgaaactgacagatgtttttctaaaaaggactattatcagtttccaaatacaatacttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtgaagatgcttagatgtatagttttgataaccacagttttaaatcttttatctgtgcataataaaaagatatatatcagttatt

SEQ ID NO: 32062 - DNA, 4550 bp, Homo sapiens
aagaatcttgtttttttgagacggagtctcaccctgtcgcccgggctggagtgcagtggcgcgatcgcaacctccgcttcccgggttcaagggattctcctgcctcagcctcctgagtagctgggactacaggcgcacgccactacacccggccaatttttgtatttatttattttattttattttattttttagtagagacggggtttcaccatgttggccagaacagtctcgatctcctaacctcgtgatccacccgcctcgggctcccaaagtgttgagattacaggcgtgagccaccgcgcccgtccagaattatctttaaaatttatttctttaagatttgtagctactaagaaagaaaggagctttttttccttgggccttcaaactgaaagaaccgcatgagcctgaagctgcgcatggtcttaacatcaggctgtgcaggaagaagctatctgcagatggatgccagcacacacaaggaagcagagctctggcaacattgagtcaaagcaaggacacaacatcagagggacggcagagaatccttgtgtgtagatctttggtggcagtttgaaaattgcaaggagggactttaagactacttctgatttgcaaagattgtctgtgctctgagcaggctgaagtgactggacgagacgcactgttggagaaataaaaatgacttcccattatgtgattgccatctttgccctgatgagctcctgtttagccactgcaggtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcaggccaggggcctggccagctacagagagaggtcacacttcacctgaatcccatctcctcagtccacatccaccacaagtctgttgtgttcctgctcaactccccacaccccctggtgtggcatctgaagacagagagacttgccactggggtctccagactgtttttggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaactcaagatagcaagaaacatttatattaaagtgggggaagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatgaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccattgtgatacaggttccagcccttggggacagtagtggttggccagatggttatgaagatctggagtcaggtgataatggatttccgggagatatggatgaaggagatgcttccctgttcacccgacctgaaatcgtggtgtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtatctgttactaaggctgaacaagaactgggatttgccatccaaacgtgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttcaacacctcactgctctttctacagtgtgagctgacgctgtgtacgaagatggagaagcacccccagaagttgcctaagtgtgtgcctcctgacgaagcctgcacctcgctggacgcctcgataatctgggccatgatgcagaataagaagacgttcactaagccccttgctgtgatccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacaggggagacagcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggcaggaccaatggctgagcctcgtgtccagactcagagggctggattttggttcccttgtaaagacagagtgaatttcagtataaagatcacccgttgtattcaccccacacccagggctagtataaacatgaccctgggcttctgtaccacactagaattcatgtgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatagtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgccctcagggactgcaccctgacaagtgttaaggcaacattcctttcttgtgccctgggccaaaaccaatgctgatgaccttatcagcttcctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcagttataaagtcaaggacgaatttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaaataggccctttcataaaaaccaaactgtagcaagatgcaaatgcatggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctccttgtt

SEQ ID NO: 32063 - DNA, 551 bp, Homo sapiens
actttcctcttcccagcgagtgaaggagggcagtcggcggctctcgcgccccggccactttccctgcgcgattcccggagctccctgcaggaggtgagagtccccagcgggtccggatggcgtagttttgccgcggcgcagcagctgccggagctcgccgccgccgagcgctgggcggggaaacttgccgccgctttcctccaacttgctgcgggtggatctccgctggacacaccgcctccgagctctgcagctctcctccctcctgtaatgcttcctctgcctgcagtgtcattcatcacctgacttttaaaatcttcgcttatcctcaggcagtttgaaaattgcaaggagggactttaagactacttctgatttgcaaagattgtctgtgctctgagcaggctgaagtgactggacgagacgcactgttggagaaataaaaatgacttcccattatgtgattgccatctttgccctgatgagctcctgtttagccactgcaggtccagagcctggtgcactgtgtgaactgtcacctgtcagtgcct

SEQ ID NO: 32064 - DNA, 2908 bp, Homo sapiens
cagcgagtgaaggagggcagtcggcggctctcgcgccccggccactttccctgcgcgattcccggagctccctgcaggaggtgagagtccccagcgggtccggatggcgtagttttgccgcggcgcagcagctgccggagctcgccgccgccgagcgctgggcggggaaacttgccgccgctttcctccaacttgctgcgggtggatctccgctggacacaccgcctccgaggcagtttgaaaattgcaaggagggactttaagactacttctgatttgcaaagattgtctgtgctctgagcaggctgaagtgactggacgagacgcactgttggagaaataaaaatgacttcccattatgtgattgccatctttgccctgatgagctcctgtttagccactgcaggtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcaggccaggggcctggccagctacagagagaggtcacacttcacctgaatcccatctcctcagtccacatccaccacaagtctgttgtgttcctgctcaactccccacaccccctggtgtggcatctgaagacagagagacttgccactggggtctccagactgtttttggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaactcaagatagcaagaaacatttatattaaagtgggggaagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatgaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccattgtgatacaggttccagcccttggggacagtagtggttggccagatggttatgaagatctggagtcaggtgataatggatttccgggagatatggatgaaggagatgcttccctgttcacccgacctgaaatcgtggtgtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtatctgttactaaggctgaacaagaactgggatttgccatccaaacgtgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttcaacacctcactgctctttctacagtgtgagctgacgctgtgtacgaagatggagaagcacccccagaagttgcctaagtgtgtgcctcctgacgaagcctgcacctcgctggacgcctcgataatctgggccatgatgcagaataagaagacgttcactaagccccttgctgtgatccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacaggggagacagcaggaaggcagcaagtccccacctccccgccagcctcggaaaacagcagtgctgcccacagcatcggcagcacgcagagcacgccttgctccagcagcagcacggcctagcccaacccag

SEQ ID NO: 32065 - DNA, 3927 bp, Homo sapiens
gattgtctgtgctctgagcaggctgaagtgactggacgagacgcactgttggagaaataaaaatgacttcccattatgtgattgccatctttgccctgatgagctcctgtttagccactgcaggtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcaggccaggggcctggccagctacagagagaggtcacacttcacctgaatcccatctcctcagtccacatccaccacaagtctgttgtgttcctgctcaactccccacaccccctggtgtggcatctgaagacagagagacttgccactggggtctccagactgtttttggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaactcaagatagcaagaaacatttatattaaagtgggggaagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatgcagaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccattgtgatacaggttccagcccttggggacagtagtggttggccagatggttatgaagatctggagtcaggtgataatggatttccgggagatatggatgaaggagatgcttccctgttcacccgacctgaaatcgtggtgtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtatctgttactaaggctgaacaagaactgggatttgccatccaaacgtgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttcaacacctcactgctctttctacagtgtgagctgacgctgtgtacgaagatggagaagcacccccagaagttgcctaagtgtgtgcctcctgacgaagcctgcacctcgctggacgcctcgataatctgggccatgatgcagaataagaagacgttcactaagccccttgctgtgatccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacaggggagacagcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggcaggaccaatggctgagcctcgtgtccagactcagagggctggattttggttcccttgtaaagacagagtgaatttcagtataaagatcacccgttgtattcaccccacacccagggctagtataaacatgaccctgggcttctgtaccacactagaattcatgtgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatagtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgccctcagggactgcaccctgacaagtgttaaggcaacattcctttcttgtgccctgggccaaaaccaatgctgatgaccttatcagcttcctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcagttataaagtcaaggacgaatttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaaataggccctttcataaaaaccaaactgtagcaagatgcaaatgcatggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctcct

SEQ ID NO: 32066 - DNA, 2695 bp, Homo sapiens
gccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtagagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtctttgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccaggcctgagcagcctcaggtcctctgttcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaac

SEQ ID NO: 32067 - DNA, 1942 bp, Homo sapiens
tctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtagagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtctttgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtag

SEQ ID NO: 32068 - DNA, 2804 bp, Homo sapiens
ctccttgcacgggccggcccagcttccccgcccctggcgtccgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtagagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtctttgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacat

SEQ ID NO: 32069 - DNA, 6513 bp, Homo sapiens
cagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcaggagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 32070 - DNA, 7802 bp, Homo sapiens
agctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 32071 - DNA, 6145 bp, Homo sapiens
atgggaggctcccactctcagaccccgaggggccgggaacccgccggggagaggcacccgagacccacggagaccgcgactactgaacaagtgaaatttctctgttttctgttgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 32072 - DNA, 6109 bp, Homo sapiens
atgggaggctcccactctcagaccccgaggggccgggaacccgccggggagaggcacccgagacccacggagaccgcgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 32073 - DNA, 7838 bp, Homo sapiens
agctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgactactgaacaagtgaaatttctctgttttctgttgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 32074 - DNA, 2635 bp, Homo sapiens
agatgcgaaatcagcggtagcaggtggcgcagaagggagaggggagcgaccctggggaccgactctggggaccctcgccgaagagtcccaagggttccaaggccagagagaggtcctggtcttgattgctggcatgtttactcttccaagtacactgagatcaaatgcaaagacaaaccatcaaaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgccccttt

SEQ ID NO: 32075 - DNA, 2428 bp, Homo sapiens
gagagatgcgaaatcagcggtagcaggtggcgcagaagggagaggggagcgaccctggggaccgactctggggaccctcgccgaagagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatactttaataaagaagtatttcgaggagatatctgtccaaaaaggtttggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtcct

SEQ ID NO: 32076 - DNA, 3011 bp, Homo sapiens
ggggaccgactctggggaccctcgccgaagagtcccaagggttccaaggccagagagaggtcctggtcttgattgctggcatgtttactcttccaagtacactgagatcaaatgcaaagacaaaccatcaaagaaaataactctaaaatctggacatgatatacaaagtgactgcctaaaggagctgaagagaggacataagtggatcgcctctgctgttgcatgttggcttggagaacagaagatgaggagccaaataagcaagtccttcagccccaggcttctagcacggggctgcatgtaggctatgcattctggggagtgaggagatcatgaatgctgaaaataaatgaaggaatccagaaaagcaagagtcaaagaaggcatctgcaggccaaatctctgatcaacccctgacccacatacacacaaaatacactcaaagcagctcagctaaagacaaagatctgcactcagagtagagctgcctccccagaaacagagctcgcagttcaggcccagcaagaaaattacctgcaaaacaaaggaaaaacaacactcatcagagaaaaagaacagaatctggaatcttcacaacctagcattcatcatatccaagattgaaacccaaattatgggacatatttaaaaaccaggaaaatggaacgtagtcttaagagaaaagtcaatcaaatctgacctggagatgaataatatattgaaacttaaaagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaa

SEQ ID NO: 32077 - DNA, 5509 bp, Homo sapiens
acaggatgtttctgagccaagttgaagcaaaagaaactttttccagcatgtcaggaacgaagctgacgttccattaagaaaaaaaaaaaaaaaaaaagaagtgctagaggaaggagtaagaggtgaaaaggcaccagaattcagacggagctttaaattccagacagggccagcgttgggagcacgtaggaggcgcccctcggaaaggagccggagacccagctgacttcgcacttgagctccagccccgtggacatttcctgttctgcctctggaaattcaagctgaaagttacaaaacatccttttccctggaaccaagtgcttggttgggagaccatgccctccccttccttcctcggaactcctccctgatcgccccgtggcttccccaggagagatgcgaaatcagcggtagcaggtggcgcagaagggagaggggagcgaccctggggaccgactctggggaccctcgccgaagagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaa

SEQ ID NO: 32078 - DNA, 2564 bp, Homo sapiens
agtcgctccccggcccttcccggggccctaccgtgtacccaaaacgcagccgcggtgaagaaggtcgcgtgatgacaggcccctggcagctgctgggaaatggtggtctctgccgggctgtcatccgcgtgattgcggaagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggt

SEQ ID NO: 32079 - DNA, 660 bp, Homo sapiens
agtcgctccccggcccttcccggggccctaccgtgtacccaaaacgcagccgcggtgaagaaggtcgcgtgatgacaggcccctggcagctgctgggaaatggtggtctctgccgggctgtcatccgcgtgattgcggaaggcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagca

SEQ ID NO: 32080 - DNA, 967 bp, Homo sapiens
aagaaggtcgcgtgatgacaggcccctggcagctgctgggaaatggtggtctctgccgggctgtcatccgcgtgattgcggaaggcaggtgacaccattcttagcctcgggcccagggagttccagcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggcc

SEQ ID NO: 32081 - DNA, 685 bp, Homo sapiens
gtgcaaatgtgttgtgggccttgaggtggcagtcctatgaggcggtggtagggctttcccctgattcagtactcagctggtcccaaggggctttgagtgtggcttttgcctccttaactggatgctgaataggctccttgcacttattttgggactccgttgtgcctgtgcccagcacagggtgtgctgctggtgaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggaggg

SEQ ID NO: 32082 - DNA, 476 bp, Homo sapiens
agaaacagaaccctgtgtcaaatccaggagcctgggggactgtagaacctgaagttttactgggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactct

SEQ ID NO: 32083 - DNA, 3644 bp, Homo sapiens
cgccccggctcccggctgcaggaatcgcgccaggacgctggccccgctcgcggctagcttgcacgccagggcacagcgaggatgggagggtcgcagtccctgcagccagccccagccagcgacctgaacctggaggcttccgaggcaatgagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccaggaggagttagagtttgccatcatgcggatagaagccctgaagctggccaggcagattgctttggcttcccgcagccaccaggatgccaagagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttg

SEQ ID NO: 32084 - DNA, 9377 bp, Homo sapiens
gtcacctctgacaaaattctggggacgctgggaacactgaatcaacatgggcaatgagaacagcacctcggacaaccagaggactttatcagctcagactccaaggtccgcgcagccacccgggaacagtcagaatataaaaaggaagcagcaggacacgcccggaagccctgaccacagagacgcgtccagcattggcagcgttgggcttggaggcttctgcaccgcttctgagagttctgccagcctggatccatgccttgtgtccccagaggtgactgagccaaggaaggacccacagggagccagggggccagaaggttctttgctgcccagcccaccaccgtcccaggagcgagagcacccctcgtcctccatgccctttgccgagtgtcccccggaaggttgcttggcaagtccagcagcggcacctgaagatggtcctcagactcagtctcccaggagggaacctgccccaaatgccccaggagacatcgcggcggcatttcccgctgagagggacagctctactccataccaagagattgctgccgtccccagtgctggaagagagagacagccgaaggaagaaggacagaagtcctccttctccttctccagtggcatcgaccagtcacctggaatgtcgccagtacccctcagagagccaatgaaggcaccgctgtgtggagagggggaccagcctggtggttttgagtcccaagagaaagaggctgcaggtggctttccccctgcagagtccaggcagggggtggcttctgtgcaagtgacccctgaggcccctgctgcagcccagcagggcacagaaagctcagcggtcttggagaagtcccccctaaaacccatggccccgatcccacaagatccagccccaagagcctcagacagagaaagaggccaaggggaggcgccgcctcagtatttaacagatgacttggaattcctcagggcctgccatctccctaggagcaattcaggggctgccccagaagcagaagtgaatgccgcttcccaggagagctgccagcagccagtgggagcatatctgccgcacgcagagctgccctggggcttgccaagtcctgccctggtgccagaggctgggggctctgggaaggaggctctggacaccattgatgttcagggtcacccacagacagggatgcgaggaaccaagcccaatcaagttgtctgtgtggcagcaggcggccagcccgaagggggtttgcctgtgagccctgaaccttccctgctcactccgactgaggaagcacatccagcttcaagcctcgcttcattcccagctgctcagattcctattgctgtagaagaacctggatcatcatccagggaatcagtttccaaggctgggatgccagtttctgcagatgcagccaaagaggtggtggatgcagggttggtgggactggagaggcaggtgtcagatcttggaagcaagggagagcatccagaaggggaccctggagaggttcctgccccatcaccccaggagaggggagagcacttgaacacggagcaaagccatgaggtccaaccaggagtaccaccccctcctcttcccaaggagcaaagccatgaggtccaaccaggagcaccaccccctcctcttcccaaggcaccaagtgaaagtgccagagggccaccggggccaacggatggagccaaggtccatgaagattccacaagcccagccgtggctaaagaaggaagcagatcacctggtgacagccctggaggaaaggaggaagccccagagccacctgatggtggagacccagggaacctgcaaggagaggactctcaggctttcagcagcaagcgtgatccagaagtaggcaaagatgagctttcaaagccaagcagtgatgcagagagcagagaccatcccagctcacactcagcacagccacccagaaaggggggtgctgggcacacggacgggccccactctcagacagcagaggctgatgcatctggcctaccacacaagctgggtgaggaggaccccgtcctgccccctgtgccagatggagctggtgagcccactgttcccgaaggagccatctgggaggggtcaggattgcagcccaaatgtcctgacacccttcagagcagggaaggattgggaagaatggagtctttcctgactttagaatcagagaaatcagattttccaccaactcctgttgcagaggttgcacccaaagcccaggaaggtgagagcacattggaaataaggaagatgggcagctgtgatggggagggcttgctgacgtccccagatcaaccccgcgggccggcgtgtgatgcgtcgagacaggaatttcatgctggggtgccacatcccccccagggggagaacttggcagcagacctggggctcacggcactcatcctggaccaagatcagcagggaatcccatcctgcccaggggaaggctggataagaggagctgcatccgagtggcccctactatcttctgagaagcatctccagccatcccaggcacaaccagagacatccatctttgacgtgctcaaggagcaggcccagccacctgaaaatgggaaagagacttctccaagccatccaggttttaaggaccagggagcagattcttcccaaatccatgtacctgtggaacctcaggaagataacaacttgcccactcatggaggacaggagcaggctttgggatcagaacttcaaagtcagctccccaaaggcaccctgtctgatactccaacttcatctcccactgacatggtttgggagagttctctgacagaagagtcagaattgtcagcaccaacgagacagaagttgcctgcactaggggagaagcggccagagggagcatgcggtgatggtcagtcctcgagggtctcgcctccagcagcagatgtcttaaaagacttttctcttgcagggaacttcagcagaaaggaaacttgctgcactgggcaggggccaaacaagtctcaacaggcattggctgatgccttggaagaaggcagccagcatgaagaagcatgtcaaaggcatccaggagcttctgaagcagctgatggttgttccccactctggggcttgagtaagagggagatggcaagtggaaacacaggggaggccccaccttgtcagcctgactcagtagctctcctggatgcagttccctgcctgccagccctggcgcccgccagccccggagtcacacccacccaggatgccccagagacagaggcatgtgatgaaacccaggaaggcaggcagcaaccagtgccggccccgcagcagaaaatggagtgctgggccacttcggatgcagagtccccaaagcttcttgcaagtttcccatcagctggggagcaaggtggtgaagccggggctgctgagactggtggcagcgctggtgcaggagacccaggaaagcagcaggctccggagaaacctggagaagctactttgagttgtggcctccttcagactgagcactgccttacctccggggaggaagcttctacctctgccctacgtgagtcctgccaagctgagcaccccatggccagctgccaggatgccttgctgccagccagagagctgggtgggattcccaggagcaccatggatttttctacacaccaggctgtcccagacccaaaggagctcctgctgtctgggccaccagaagtggctgctcctgacaccccttacctgcatgtcgacagtgctgcccagagaggagcagaagacagtggagtgaaagctgtttcctctgcagaccccagagctcctggcgaaagcccctgtcctgtaggggagcccccacttgccttggaaaatgctgcctccttgaagctgtttgctggctccctcgcccccctgttgcaaccaggagctgcaggtggggaaatccctgcagtgcaagccagcagtggtagtcccaaagccagaaccactgagggaccagtggactccatgccatgcctggaccggatgccacttctggccaagggcaagcaggcaacaggggaagagaaagcagcaacagctccaggtgcaggtgccaaggccagtggggagggcatggcaggtgatgcagcaggagagacagagggcagcatggagaggatgggagagccttcccaggacccaaagcagggcacatcaggtggtgtggacacaagctctgagcaaatcgccaccctcactggcttcccagacttcagggagcacatcgccaagatcttcgagaagcctgtgctcggagccctggccacacctggagaaaaggcaggagctgggaggagtgcagtgggtaaagacctcaccaggccattgggcccagagaagcttctagatgggcctccaggagtggatgtcacccttctccctgcacctcctgctcgactccaggtggagaagaagcaacagttggctggagaggctgagatttcccatctggctctgcaagatccagcttcagacaagcttctgggtccagcagggctgacctgggagcggaacttgccaggtgccggtgtggggaaggagatggcaggtgtcccacccacactgagggaagacgagaggccagaggggcctggggcagcctggccaggcctggaaggccaggcttactcacagctggagaggagcaggcaggaattagcttcaggtcttccttcaccagcagctactcaggagctccctgtggagagagctgctgccttccaggtggctccccatagccatggagaagaggccgtggcccaagacagaattccttctggaaagcagcaccaggaaacatctgcctgcgacagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactgctggcatcttggaaatgcgaaatgccctgggcaaccagagcacccctgcaccaccaactggagaagtggcagacactcccctggagcctggcaaggtggcaggcgctgctggggaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccagggcctgagcgccccattccagctggggatgggaaggtgtgcgtctcctcacctccagagcctgacgaaactcacgacccgaagctgcaacatttggctccagaagagctccacactgacagagagagccccaggcctggcccatccatgttaccttcggttcctaagaaggatgctccaagagtcatggataaagtcacttcagatgagaccagaggtgcggaaggaacagaaagttcacctgtggcagatgatatcatccagcccgctgcccccgcagacctggaaagcccaaccttagctgcctcttcctaccacggtgatgttgttggccaggtctctacggatctgatagcccagagcatctccccagctgctgcccatgcgggtcttcctccctcggctgcagaacacatagtttcgccatctgccccagctggtgacagagtagaagcttccactccctcctgcccagatccggccaaggacctcagcaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccaggaggagttagagtttgccatcatgcggatagaagccctgaagctggccaggcagattgctttggcttcccgcagccaccaggatgccaagagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggc

SEQ ID NO: 32085 - DNA, 9070 bp, Homo sapiens
cagaggactttatcagctcagactccaaggtccgcgcagccacccgggaacagtcagaatataaaaaggaagcagcaggacacgcccggaagccctgaccacagagacgcgtccagcattggcagcgttgggcttggaggcttctgcaccgcttctgagagttctgccagcctggatccatgccttgtgtccccagaggtgactgagccaaggaaggacccacagggagccagggggccagaaggttctttgctgcccagcccaccaccgtcccaggagcgagagcacccctcgtcctccatgccctttgccgagtgtcccccggaaggttgcttggcaagtccagcagcggcacctgaagatggtcctcagactcagtctcccaggagggaacctgccccaaatgccccaggagacatcgcggcggcatttcccgctgagagggacagctctactccataccaagagattgctgccgtccccagtgctggaagagagagacagccgaaggaagaaggacagaagtcctccttctccttctccagtggcatcgaccagtcacctggaatgtcgccagtacccctcagagagccaatgaaggcaccgctgtgtggagagggggaccagcctggtggttttgagtcccaagagaaagaggctgcaggtggctttccccctgcagagtccaggcagggggtggcttctgtgcaagtgacccctgaggcccctgctgcagcccagcagggcacagaaagctcagcggtcttggagaagtcccccctaaaacccatggccccgatcccacaagatccagccccaagagcctcagacagagaaagaggccaaggggaggcgccgcctcagtatttaacagatgacttggaattcctcagggcctgccatctccctaggagcaattcaggggctgccccagaagcagaagtgaatgccgcttcccaggagagctgccagcagccagtgggagcatatctgccgcacgcagagctgccctggggcttgccaagtcctgccctggtgccagaggctgggggctctgggaaggaggctctggacaccattgatgttcagggtcacccacagacagggatgcgaggaaccaagcccaatcaagttgtctgtgtggcagcaggcggccagcccgaagggggtttgcctgtgagccctgaaccttccctgctcactccgactgaggaagcacatccagcttcaagcctcgcttcattcccagctgctcagattcctattgctgtagaagaacctggatcatcatccagggaatcagtttccaaggctgggatgccagtttctgcagatgcagccaaagaggtggtggatgcagggttggtgggactggagaggcaggtgtcagatcttggaagcaagggagagcatccagaaggggaccctggagaggttcctgccccatcaccccaggagaggggagagcacttgaacacggagcaaagccatgaggtccaaccaggagtaccaccccctcctcttcccaaggagcaaagccatgaggtccaaccaggagcaccaccccctcctcttcccaaggcaccaagtgaaagtgccagagggccaccggggccaacggatggagccaaggtccatgaagattccacaagcccagccgtggctaaagaaggaagcagatcacctggtgacagccctggaggaaaggaggaagccccagagccacctgatggtggagacccagggaacctgcaaggagaggactctcaggctttcagcagcaagcgtgatccagaagtaggcaaagatgagctttcaaagccaagcagtgatgcagagagcagagaccatcccagctcacactcagcacagccacccagaaaggggggtgctgggcacacggacgggccccactctcagacagcagaggctgatgcatctggcctaccacacaagctgggtgaggaggaccccgtcctgccccctgtgccagatggagctggtgagcccactgttcccgaaggagccatctgggaggggtcaggattgcagcccaaatgtcctgacacccttcagagcagggaaggattgggaagaatggagtctttcctgactttagaatcagagaaatcagattttccaccaactcctgttgcagaggttgcacccaaagcccaggaaggtgagagcacattggaaataaggaagatgggcagctgtgatggggagggcttgctgacgtccccagatcaaccccgcgggccggcgtgtgatgcgtcgagacaggaatttcatgctggggtgccacatcccccccagggggagaacttggcagcagacctggggctcacggcactcatcctggaccaagatcagcagggaatcccatcctgcccaggggaaggctggataagaggagctgcatccgagtggcccctactatcttctgagaagcatctccagccatcccaggcacaaccagagacatccatctttgacgtgctcaaggagcaggcccagccacctgaaaatgggaaagagacttctccaagccatccaggttttaaggaccagggagcagattcttcccaaatccatgtacctgtggaacctcaggaagataacaacttgcccactcatggaggacaggagcaggctttgggatcagaacttcaaagtcagctccccaaaggcaccctgtctgatactccaacttcatctcccactgacatggtttgggagagttctctgacagaagagtcagaattgtcagcaccaacgagacagaagttgcctgcactaggggagaagcggccagagggagcatgcggtgatggtcagtcctcgagggtctcgcctccagcagcagatgtcttaaaagacttttctcttgcagggaacttcagcagaaaggaaacttgctgcactgggcaggggccaaacaagtctcaacaggcattggctgatgccttggaagaaggcagccagcatgaagaagcatgtcaaaggcatccaggagcttctgaagcagctgatggttgttccccactctggggcttgagtaagagggagatggcaagtggaaacacaggggaggccccaccttgtcagcctgactcagtagctctcctggatgcagttccctgcctgccagccctggcgcccgccagccccggagtcacacccacccaggatgccccagagacagaggcatgtgatgaaacccaggaaggcaggcagcaaccagtgccggccccgcagcagaaaatggagtgctgggccacttcggatgcagagtccccaaagcttcttgcaagtttcccatcagctggggagcaaggtggtgaagccggggctgctgagactggtggcagcgctggtgcaggagacccaggaaagcagcaggctccggagaaacctggagaagctactttgagttgtggcctccttcagactgagcactgccttacctccggggaggaagcttctacctctgccctacgtgagtcctgccaagctgagcaccccatggccagctgccaggatgccttgctgccagccagagagctgggtgggattcccaggagcaccatggatttttctacacaccaggctgtcccagacccaaaggagctcctgctgtctgggccaccagaagtggctgctcctgacaccccttacctgcatgtcgacagtgctgcccagagaggagcagaagacagtggagtgaaagctgtttcctctgcagaccccagagctcctggcgaaagcccctgtcctgtaggggagcccccacttgccttggaaaatgctgcctccttgaagctgtttgctggctccctcgcccccctgttgcaaccaggagctgcaggtggggaaatccctgcagtgcaagccagcagtggtagtcccaaagccagaaccactgagggaccagtggactccatgccatgcctggaccggatgccacttctggccaagggcaagcaggcaacaggggaagagaaagcagcaacagctccaggtgcaggtgccaaggccagtggggagggcatggcaggtgatgcagcaggagagacagagggcagcatggagaggatgggagagccttcccaggacccaaagcagggcacatcaggtggtgtggacacaagctctgagcaaatcgccaccctcactggcttcccagacttcagggagcacatcgccaagatcttcgagaagcctgtgctcggagccctggccacacctggagaaaaggcaggagctgggaggagtgcagtgggtaaagacctcaccaggccattgggcccagagaagcttctagatgggcctccaggagtggatgtcacccttctccctgcacctcctgctcgactccaggtggagaagaagcaacagttggctggagaggctgagatttcccatctggctctgcaagatccagcttcagacaagcttctgggtccagcagggctgacctgggagcggaacttgccaggtgccggtgtggggaaggagatggcaggtgtcccacccacactgagggaagacgagaggccagaggggcctggggcagcctggccaggcctggaaggccaggcttactcacagctggagaggagcaggcaggaattagcttcaggtcttccttcaccagcagctactcaggagctccctgtggagagagctgctgccttccaggtggctccccatagccatggagaagaggccgtggcccaagacagaattccttctggaaagcagcaccaggaaacatctgcctgcgacagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactgctggcatcttggaaatgcgaaatgccctgggcaaccagagcacccctgcaccaccaactggagaagtggcagacactcccctggagcctggcaaggtggcaggcgctgctggggaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccagggcctgagcgccccattccagctggggatgggaaggtgtgcgtctcctcacctccagagcctgacgaaactcacgacccgaagctgcaacatttggctccagaagagctccacactgacagagagagccccaggcctggcccatccatgttaccttcggttcctaagaaggatgctccaagagtcatggataaagtcacttcagatgagaccagaggtgcggaaggaacagaaagttcacctgtggcagatgatatcatccagcccgctgcccccgcagacctggaaagcccaaccttagctgcctcttcctaccacggtgatgttgttggccaggtctctacggatctgatagcccagagcatctccccagctgctgcccatgcgggtcttcctccctcggctgcagaacacatagtttcgccatctgccccagctggtgacagagtagaagcttccactccctcctgcccagatccggccaaggacctcagcaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggc

SEQ ID NO: 32086 - DNA, 3815 bp, Homo sapiens
gtcacctctgacaaaattctggggacgctgggaacactgaatcaacatgggcaatgagaacagcacctcggacaaccagaggactttatcagctcagactccaaggtccgcgcagccacccgggaacagtcagaatataaaaaggaagcagcaggacacgcccggaagccctgaccacagagacgcgtccagttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccaggaggagttagagtttgccatcatgcggatagaagccctgaagctggccaggcagattgctttggcttcccgcagccaccaggatgccaagagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggc

SEQ ID NO: 32087 - DNA, 3979 bp, Homo sapiens
gcgggcggtcccggcgaggcgggaggggccggggcagagggagggtcttcgcctccccacccccagccccgtttccggagcccgcgatggagctttgtgaagatgcaggcgttggggctgctcggcgatgatgacatcatcgtgtcacacacaggagccggctgccggggggtttaagagaagagcctttcggaccacaccggcgctcacgctcatacccgcacgccccgggcagagccgcgcacgccggccacactcgggcgcgcgccggccacactcgcgcgcacacatacgcggcgctcgccccccggcccccggctcgggccgcgagtcgcagctccctgccgccgctcccgccgccacggatgcccgcagctgctcccctctgcagtgcagcaaccccggccgccggccggctcgccccggctcccggctgcaggaatcgcgccaggacgctggccccgctcgcggctagcttgcacgccagggcacagcgaggatgggagggtcgcagtccctgcagccagccccagccagcgacctgaacctggaggcttccgaggcaatgagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccagagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaataa

SEQ ID NO: 32088 - DNA, 3813 bp, Homo sapiens
ggaaagccctttgcacacatcggcctattgaagcactttgcttgattcagctattctcctctcaggacctgcctggatcatcccagcctgtagaatcctgggtttctgtggcagtttgttcttctggtatcacctgctatgctctgaatgtttgtatccctctcagccccgaaattcctgtgttgaaatcctaacccctaaggtgatggtatgaggaggtggggccttcgggaggtgattaggccataagggtggagcctttgtgaatgggattagtgcccttataaaaagaggccccacagcactgccttgcctcttctgccacgtgaagatgcagtgagaaggagctgtctgtgaactaggaaggggtcctcatgagacactgaacctgctggtgccttgatcttggacttcccagcctccagaactttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagacggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaata

SEQ ID NO: 32089 - DNA, 9673 bp, Homo sapiens
caggagagaagaaacgcaaatcccagaaccgtgccaacatataaaaccccacattaagggttgtacagtgcactgggatttctcaagtcacccgcttggtcctcttccaagtatactttacttcctttcattcctctctaaaacttttttaaaaactttcactcctgctctaaaagttatcttggtttcttactctaccttatgccccttgggcgaattttttcctctgaggagggaagaatagagttgctgctgcagacacatcagattccctactggtaacagctggagtgcgtcacctctgacaaaattctggggacgctgggaacactgaatcaacatgggcaatgagaacagcacctcggacaaccagaggactttatcagctcagactccaaggtccgcgcagccacccgggaacagtcagaatataaaaaggaagcagcaggacacgcccggaagccctgaccacagagacgcgtccagcattggcagcgttgggcttggaggcttctgcaccgcttctgagagttctgccagcctggatccatgccttgtgtccccagaggtgactgagccaaggaaggacccacagggagccagggggccagaaggttctttgctgcccagcccaccaccgtcccaggagcgagagcacccctcgtcctccatgccctttgccgagtgtcccccggaaggttgcttggcaagtccagcagcggcacctgaagatggtcctcagactcagtctcccaggagggaacctgccccaaatgccccaggagacatcgcggcggcatttcccgctgagagggacagctctactccataccaagagattgctgccgtccccagtgctggaagagagagacagccgaaggaagaaggacagaagtcctccttctccttctccagtggcatcgaccagtcacctggaatgtcgccagtacccctcagagagccaatgaaggcaccgctgtgtggagagggggaccagcctggtggttttgagtcccaagagaaagaggctgcaggtggctttccccctgcagagtccaggcagggggtggcttctgtgcaagtgacccctgaggcccctgctgcagcccagcagggcacagaaagctcagcggtcttggagaagtcccccctaaaacccatggccccgatcccacaagatccagccccaagagcctcagacagagaaagaggccaaggggaggcgccgcctcagtatttaacagatgacttggaattcctcagggcctgccatctccctaggagcaattcaggggctgccccagaagcagaagtgaatgccgcttcccaggagagctgccagcagccagtgggagcatatctgccgcacgcagagctgccctggggcttgccaagtcctgccctggtgccagaggctgggggctctgggaaggaggctctggacaccattgatgttcagggtcacccacagacagggatgcgaggaaccaagcccaatcaagttgtctgtgtggcagcaggcggccagcccgaagggggtttgcctgtgagccctgaaccttccctgctcactccgactgaggaagcacatccagcttcaagcctcgcttcattcccagctgctcagattcctattgctgtagaagaacctggatcatcatccagggaatcagtttccaaggctgggatgccagtttctgcagatgcagccaaagaggtggtggatgcagggttggtgggactggagaggcaggtgtcagatcttggaagcaagggagagcatccagaaggggaccctggagaggttcctgccccatcaccccaggagaggggagagcacttgaacacggagcaaagccatgaggtccaaccaggagtaccaccccctcctcttcccaaggagcaaagccatgaggtccaaccaggagcaccaccccctcctcttcccaaggcaccaagtgaaagtgccagagggccaccggggccaacggatggagccaaggtccatgaagattccacaagcccagccgtggctaaagaaggaagcagatcacctggtgacagccctggaggaaaggaggaagccccagagccacctgatggtggagacccagggaacctgcaaggagaggactctcaggctttcagcagcaagcgtgatccagaagtaggcaaagatgagctttcaaagccaagcagtgatgcagagagcagagaccatcccagctcacactcagcacagccacccagaaaggggggtgctgggcacacggacgggccccactctcagacagcagaggctgatgcatctggcctaccacacaagctgggtgaggaggaccccgtcctgccccctgtgccagatggagctggtgagcccactgttcccgaaggagccatctgggaggggtcaggattgcagcccaaatgtcctgacacccttcagagcagggaaggattgggaagaatggagtctttcctgactttagaatcagagaaatcagattttccaccaactcctgttgcagaggttgcacccaaagcccaggaaggtgagagcacattggaaataaggaagatgggcagctgtgatggggagggcttgctgacgtccccagatcaaccccgcgggccggcgtgtgatgcgtcgagacaggaatttcatgctggggtgccacatcccccccagggggagaacttggcagcagacctggggctcacggcactcatcctggaccaagatcagcagggaatcccatcctgcccaggggaaggctggataagaggagctgcatccgagtggcccctactatcttctgagaagcatctccagccatcccaggcacaaccagagacatccatctttgacgtgctcaaggagcaggcccagccacctgaaaatgggaaagagacttctccaagccatccaggttttaaggaccagggagcagattcttcccaaatccatgtacctgtggaacctcaggaagataacaacttgcccactcatggaggacaggagcaggctttgggatcagaacttcaaagtcagctccccaaaggcaccctgtctgatactccaacttcatctcccactgacatggtttgggagagttctctgacagaagagtcagaattgtcagcaccaacgagacagaagttgcctgcactaggggagaagcggccagagggagcatgcggtgatggtcagtcctcgagggtctcgcctccagcagcagatgtcttaaaagacttttctcttgcagggaacttcagcagaaaggaaacttgctgcactgggcaggggccaaacaagtctcaacaggcattggctgatgccttggaagaaggcagccagcatgaagaagcatgtcaaaggcatccaggagcttctgaagcagctgatggttgttccccactctggggcttgagtaagagggagatggcaagtggaaacacaggggaggccccaccttgtcagcctgactcagtagctctcctggatgcagttccctgcctgccagccctggcgcccgccagccccggagtcacacccacccaggatgccccagagacagaggcatgtgatgaaacccaggaaggcaggcagcaaccagtgccggccccgcagcagaaaatggagtgctgggccacttcggatgcagagtccccaaagcttcttgcaagtttcccatcagctggggagcaaggtggtgaagccggggctgctgagactggtggcagcgctggtgcaggagacccaggaaagcagcaggctccggagaaacctggagaagctactttgagttgtggcctccttcagactgagcactgccttacctccggggaggaagcttctacctctgccctacgtgagtcctgccaagctgagcaccccatggccagctgccaggatgccttgctgccagccagagagctgggtgggattcccaggagcaccatggatttttctacacaccaggctgtcccagacccaaaggagctcctgctgtctgggccaccagaagtggctgctcctgacaccccttacctgcatgtcgacagtgctgcccagagaggagcagaagacagtggagtgaaagctgtttcctctgcagaccccagagctcctggcgaaagcccctgtcctgtaggggagcccccacttgccttggaaaatgctgcctccttgaagctgtttgctggctccctcgcccccctgttgcaaccaggagctgcaggtggggaaatccctgcagtgcaagccagcagtggtagtcccaaagccagaaccactgagggaccagtggactccatgccatgcctggaccggatgccacttctggccaagggcaagcaggcaacaggggaagagaaagcagcaacagctccaggtgcaggtgccaaggccagtggggagggcatggcaggtgatgcagcaggagagacagagggcagcatggagaggatgggagagccttcccaggacccaaagcagggcacatcaggtggtgtggacacaagctctgagcaaatcgccaccctcactggcttcccagacttcagggagcacatcgccaagatcttcgagaagcctgtgctcggagccctggccacacctggagaaaaggcaggagctgggaggagtgcagtgggtaaagacctcaccaggccattgggcccagagaagcttctagatgggcctccaggagtggatgtcacccttctccctgcacctcctgctcgactccaggtggagaagaagcaacagttggctggagaggctgagatttcccatctggctctgcaagatccagcttcagacaagcttctgggtccagcagggctgacctgggagcggaacttgccaggtgccggtgtggggaaggagatggcaggtgtcccacccacactgagggaagacgagaggccagaggggcctggggcagcctggccaggcctggaaggccaggcttactcacagctggagaggagcaggcaggaattagcttcaggtcttccttcaccagcagctactcaggagctccctgtggagagagctgctgccttccaggtggctccccatagccatggagaagaggccgtggcccaagacagaattccttctggaaagcagcaccaggaaacatctgcctgcgacagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactgctggcatcttggaaatgcgaaatgccctgggcaaccagagcacccctgcaccaccaactggagaagtggcagacactcccctggagcctggcaaggtggcaggcgctgctggggaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccagggcctgagcgccccattccagctggggatgggaaggtgtgcgtctcctcacctccagagcctgacgaaactcacgacccgaagctgcaacatttggctccagaagagctccacactgacagagagagccccaggcctggcccatccatgttaccttcggttcctaagaaggatgctccaagagtcatggataaagtcacttcagatgagaccagaggtgcggaaggaacagaaagttcacctgtggcagatgatatcatccagcccgctgcccccgcagacctggaaagcccaaccttagctgcctcttcctaccacggtgatgttgttggccaggtctctacggatctgatagcccagagcatctccccagctgctgcccatgcgggtcttcctccctcggctgcagaacacatagtttcgccatctgccccagctggtgacagagtagaagcttccactccctcctgcccagatccggccaaggacctcagcaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccaggaggagttagagtttgccatcatgcggatagaagccctgaagctggccaggcagattgctttggcttcccgcagccaccaggatgccaagagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaa

SEQ ID NO: 32090 - DNA, 8963 bp, Homo sapiens
gtcacctctgacaaaattctggggacgctgggaacactgaatcaacatgggcaatgagaacagcacctcggacaaccagaggactttatcagctcagactccaaggtccgcgcagccacccgggaacagtcagaatataaaaaggaagcagcaggacacgcccggaagccctgaccacagagacgcgtccagcattggcagcgttgggcttggaggcttctgcaccgcttctgagagttctgccagcctggatccatgccttgtgtccccagaggtgactgagccaaggaaggacccacagggagccagggggccagaaggttctttgctgcccagcccaccaccgtcccaggagcgagagcacccctcgtcctccatgccctttgccgagtgtcccccggaaggttgcttggcaagtccagcagcggcacctgaagatggtcctcagactcagtctcccaggagggaacctgccccaaatgccccaggagacatcgcggcggcatttcccgctgagagggacagctctactccataccaagagattgctgccgtccccagtgctggaagagagagacagccgaaggaagaaggacagaagtcctccttctccttctccagtggcatcgaccagtcacctggaatgtcgccagtacccctcagagagccaatgaaggcaccgctgtgtggagagggggaccagcctggtggttttgagtcccaagagaaagaggctgcaggtggctttccccctgcagagtccaggcagggggtggcttctgtgcaagtgacccctgaggcccctgctgcagcccagcagggcacagaaagctcagcggtcttggagaagtcccccctaaaacccatggccccgatcccacaagatccagccccaagagcctcagacagagaaagaggccaaggggaggcgccgcctcagtatttaacagatgacttggaattcctcagggcctgccatctccctaggagcaattcaggggctgccccagaagcagaagtgaatgccgcttcccaggagagctgccagcagccagtgggagcatatctgccgcacgcagagctgccctggggcttgccaagtcctgccctggtgccagaggctgggggctctgggaaggaggctctggacaccattgatgttcagggtcacccacagacagggatgcgaggaaccaagcccaatcaagttgtctgtgtggcagcaggcggccagcccgaagggggtttgcctgtgagccctgaaccttccctgctcactccgactgaggaagcacatccagcttcaagcctcgcttcattcccagctgctcagattcctattgctgtagaagaacctggatcatcatccagggaatcagtttccaaggctgggatgccagtttctgcagatgcagccaaagaggtggtggatgcagggttggtgggactggagaggcaggtgtcagatcttggaagcaagggagagcatccagaaggggaccctggagaggttcctgccccatcaccccaggagaggggagagcacttgaacacggagcaaagccatgaggtccaaccaggagtaccaccccctcctcttcccaaggagcaaagccatgaggtccaaccaggagcaccaccccctcctcttcccaaggcaccaagtgaaagtgccagagggccaccggggccaacggatggagccaaggtccatgaagattccacaagcccagccgtggctaaagaaggaagcagatcacctggtgacagccctggaggaaaggaggaagccccagagccacctgatggtggagacccagggaacctgcaaggagaggactctcaggctttcagcagcaagcgtgatccagaagtaggcaaagatgagctttcaaagccaagcagtgatgcagagagcagagaccatcccagctcacactcagcacagccacccagaaaggggggtgctgggcacacggacgggccccactctcagacagcagaggctgatgcatctggcctaccacacaagctgggtgaggaggaccccgtcctgccccctgtgccagatggagctggtgagcccactgttcccgaaggagccatctgggaggggtcaggattgcagcccaaatgtcctgacacccttcagagcagggaaggattgggaagaatggagtctttcctgactttagaatcagagaaatcagattttccaccaactcctgttgcagaggttgcacccaaagcccaggaaggtgagagcacattggaaataaggaagatgggcagctgtgatggggagggcttgctgacgtccccagatcaaccccgcgggccggcgtgtgatgcgtcgagacaggaatttcatgctggggtgccacatcccccccagggggagaacttggcagcagacctggggctcacggcactcatcctggaccaagatcagcagggaatcccatcctgcccaggggaaggctggataagaggagctgcatccgagtggcccctactatcttctgagaagcatctccagccatcccaggcacaaccagagacatccatctttgacgtgctcaaggagcaggcccagccacctgaaaatgggaaagagacttctccaagccatccaggttttaaggaccagggagcagattcttcccaaatccatgtacctgtggaacctcaggaagataacaacttgcccactcatggaggacaggagcaggctttgggatcagaacttcaaagtcagctccccaaaggcaccctgtctgatactccaacttcatctcccactgacatggtttgggagagttctctgacagaagagtcagaattgtcagcaccaacgagacagaagttgcctgcactaggggagaagcggccagagggagcatgcggtgatggtcagtcctcgagggtctcgcctccagcagcagatgtcttaaaagacttttctcttgcagggaacttcagcagaaaggaaacttgctgcactgggcaggggccaaacaagtctcaacaggcattggctgatgccttggaagaaggcagccagcatgaagaagcatgtcaaaggcatccaggagcttctgaagcagctgatggttgttccccactctggggcttgagtaagagggagatggcaagtggaaacacaggggaggccccaccttgtcagcctgactcagtagctctcctggatgcagttccctgcctgccagccctggcgcccgccagccccggagtcacacccacccaggatgccccagagacagaggcatgtgatgaaacccaggaaggcaggcagcaaccagtgccggccccgcagcagaaaatggagtgctgggccacttcggatgcagagtccccaaagcttcttgcaagtttcccatcagctggggagcaaggtggtgaagccggggctgctgagactggtggcagcgctggtgcaggagacccaggaaagcagcaggctccggagaaacctggagaagctactttgagttgtggcctccttcagactgagcactgccttacctccggggaggaagcttctacctctgccctacgtgagtcctgccaagctgagcaccccatggccagctgccaggatgccttgctgccagccagagagctgggtgggattcccaggagcaccatggatttttctacacaccaggctgtcccagacccaaaggagctcctgctgtctgggccaccagaagtggctgctcctgacaccccttacctgcatgtcgacagtgctgcccagagaggagcagaagacagtggagtgaaagctgtttcctctgcagaccccagagctcctggcgaaagcccctgtcctgtaggggagcccccacttgccttggaaaatgctgcctccttgaagctgtttgctggctccctcgcccccctgttgcaaccaggagctgcaggtggggaaatccctgcagtgcaagccagcagtggtagtcccaaagccagaaccactgagggaccagtggactccatgccatgcctggaccggatgccacttctggccaagggcaagcaggcaacaggggaagagaaagcagcaacagctccaggtgcaggtgccaaggccagtggggagggcatggcaggtgatgcagcaggagagacagagggcagcatggagaggatgggagagccttcccaggacccaaagcagggcacatcaggtggtgtggacacaagctctgagcaaatcgccaccctcactggcttcccagacttcagggagcacatcgccaagatcttcgagaagcctgtgctcggagccctggccacacctggagaaaaggcaggagctgggaggagtgcagtgggtaaagacctcaccaggccattgggcccagagaagcttctagatgggcctccaggagtggatgtcacccttctccctgcacctcctgctcgactccaggtggagaagaagcaacagttggctggagaggctgagatttcccatctggctctgcaagatccagcttcagacaagcttctgggtccagcagggctgacctgggagcggaacttgccaggtgccggtgtggggaaggagatggcaggtgtcccacccacactgagggaagacgagaggccagaggggcctggggcagcctggccaggcctggaaggccaggcttactcacagctggagaggagcaggcaggaattagcttcaggtcttccttcaccagcagctactcaggagctccctgtggagagagctgctgccttccaggtggctccccatagccatggagaagaggccgtggcccaagacagaattccttctggaaagcagcaccaggaaacatctgcctgcgacagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactgctggcatcttggaaatgcgaaatgccctgggcaaccagagcacccctgcaccaccaactggagaagtggcagacactcccctggagcctggcaaggtggcaggcgctgctggggaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccagggcctgagcgccccattccagctggggatgggaaggtgtgcgtctcctcacctccagagcctgacgaaactcacgacccgaagctgcaacatttggctccagaagagctccacactgacagagagagccccaggcctggcccatccatgttaccttcggttcctaagaaggatgctccaagagtcatggataaagtcacttcagatgagaccagaggtgcggaaggaacagaaaggtcagcgaaagatattggtctttggaaggccatgatgccttccttagatacagacacactggatgttttggaaaggagagtagtccttatacagcatgagttcctacataagaaagaagcaaatggccattcccgttttatgtacagttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggcc

SEQ ID NO: 32091 - DNA, 4114 bp, Homo sapiens
caggagagaagaaacgcaaatcccagaaccgtgccaacatataaaaccccacattaagggttgtacagtgcactgggatttctcaagtcacccgcttggtcctcttccaagtatactttacttcctttcattcctctctaaaacttttttaaaaactttcactcctgctctaaaagttatcttggtttcttactctaccttatgccccttgggcgaattttttcctctgaggagggaagaatagagttgctgctgcagacacatcagattccctactggtaacagctggagtgcgtcacctctgacaaaattctggggacgctgggaacactgaatcaacatgggcaatgagaacagcacctcggacaaccagaggactttatcagctcagactccaaggtccgcgcagccacccgggaacagtcagaatataaaaaggaagcagcaggacacgcccggaagccctgaccacagagacgcgtccagttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccaggaggagttagagtttgccatcatgcggatagaagccctgaagctggccaggcagattgctttggcttcccgcagccaccaggatgccaagagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaataa

SEQ ID NO: 32092 - DNA, 2781 bp, Homo sapiens
cggcggtagcagctaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgcaaagcggagactccgcacggagccgaggaggaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaacttttttaaaaactagattgctttgaaaacatgactcaataaaagtttcctttcaatttaaa

SEQ ID NO: 32093 - DNA, 1693 bp, Homo sapiens
tagcagctaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaggcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaacttttttaaaaactagattgctttgaaaacatgactcaataaaagtttcctttcaattt

SEQ ID NO: 32094 - DNA, 778 bp, Homo sapiens
agagattatgcaggcttgggttttctttctcaccatctcagcctgaaggccctttagctcttggtcccaggaagcagcagtgctgcccatggctccccctgccaggctggagaaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgagg

SEQ ID NO: 32095 - DNA, 825 bp, Homo sapiens
ccgccgccagaacctgtaccgcgccctgtcatgggacccggccctagaccgaccgccgggctgggccccctggatggtggccaggggcggctagagctgggccaagaccgacggcggagcgggcgccccgagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgcaaagcggagactccgcacgg

SEQ ID NO: 32096 - DNA, 1477 bp, Homo sapiens
caagtcttcactccttcctgcgagccctgaggaagccttgtgagtgcattggctggggcttggagggaagttgggctggagctggacaggagcagtgggtgcatttcaggcaggctctcctgaggtcccaggcgccagctccagctccctggctagggaaacccaccctctcagtcagcatgggggcccaagctccaggcagggtgggctggatcactagcgtcctggatctctctcagactgggcagccccgggctcattgaaatgccccggatgacttggctagtgcagaggaattgatggaaaccaccggggtgagagggaggctccccatctcagccagccacatccacaaggtgtgtgtaagggtgcaggcgccggccggttaggccaaggctctactgtctgttgcccctccaggagaacttccaaggagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggctgcccccatcacctctactgtctcctccctgggctaagcaggggagaagcgggctgggggtagcctggatgtgggccaagtccactgtcctccttggcggcaaaagcccattgaagaagaaccagcccagcctgccccctatcttgtcctggaatatttttggggttggaactcaaaaaaaaaaaaaaaaaatcaa

SEQ ID NO: 32097 - DNA, 491 bp, Homo sapiens
gtctgtccgaacccagacacaagtcttcactccttcctgcgagccctgaggaagccttctttccccagacatggccaacaagggtccttcctatggcatgagccgcgaagtgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggctgcccccatcacctctactgtctcctccctgggctaagcaggggagaagcgggctgggggtagcctggatgtgggccaagtccactgtcctccttggcggcaaaagcccattgaagaagaaccagcccagcctgccccctatcttgtcctggaatatttttggggttggaactcaaaaaaaaaaaaaaaaaatcaatcttt

SEQ ID NO: 32098 - DNA, 928 bp, Homo sapiens
acatcaccacggcggcagccctttaaacccctcacccagccagcgccccatcctgtctgtccgaacccagacacaagtcttcactccttcctgcgagccctgaggaagccttctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaag

SEQ ID NO: 32099 - DNA, 1048 bp, Homo sapiens
cgaacccagacacaagtcttcactccttcctgcgagccctgaggaagccttactgggcagccccgggctcattgaaatgccccggatgacttggctagtgcagaggaattgatggaaaccaccggggtgagagggaggctccccatctcagccagccacatccacaaggtgtgtgtaagggtgcaggcgccggccggttaggccaaggctctactgtctgttgcccctccaggagaacttccaaggagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagccca

SEQ ID NO: 32100 - DNA, 375 bp, Homo sapiens
gtgtgctcactcctatttgggaagagagaaggggcacagcagccctgcaggggcccctggctctgctcgtgtttctgggcttctgctgctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatgga

SEQ ID NO: 32101 - DNA, 1227 bp, Homo sapiens
aggggtctcaccagagagggagccgggggagtgcgctcctgcgtccatcctcagaccagcgtgtccctcccaacctctgacccctctgaggccaggggatgggttcggcttcctttggtacctcttttggaagtctcttcagacaaacactggagagaaggcacagcaccctagggtgacatcagtggacagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggctgcccccatcacctctactgtctcctccctgggctaagcaggggagaagcgggctgggggtagcctggatgtgggccaagtccactgtcctccttggcggcaaaagcccattgaagaagaaccagcccagcctgccccctatcttgtcctggaatatttttggggttggaactcaaaaaaaaaaaaaaaa

SEQ ID NO: 32102 - DNA, 2166 bp, Homo sapiens
cttttggaagtctcttcagacaaacactggagagaaggcacagcaccctagggtgacatcagtggacaggtcagtttcctgttcctgttcccagccacccctgtctgtctgcccagggacctacctgcctggcccactcctgctgccacccctctccatgagtgggactcctgagcagtgccaggcccaggccctcagggtggcagttgctggatggggccaggcttcccattccctggcaggcagactcttggctctggaagatccctgggggactctgacttcttggttactcaggctactccgtaagggtagccttacgagagcgtaagggcatgaggggaagtcgatgggtagaccaggtgtctctgatttctctgaggaaatgcagcttctttgccaagaactcttgggctttggtggcttcgtcgcccttgcctggggtgggcgagttttagtctcttcagctgcagaccagaagctgagctgacctgaaaagagctggagttctggagttcgggcttccaggccagggcctgcttctgggtgagagtgggaggtaatggttgcttgaggcagaggcagtaaaccctcacacccgcagctggacaaaggcaccagctggctgtattctgtgggggcaatgtggcttctggaaggtctctccagtggctctgtagctggtcttggcaaagaatgttctagaccaagggttgtcaaactacagctcatgggccaaatccagcctgctgtctgcttttgtaagtaaagttttattggaacaaagccatgttcatttgttacatattgtctatggctgctttcacactgcaacagcagagaccatgtgtcctgcaaagcctaaaatatgttctgtcttatcctttacaaaaacagtttactgacccctgctctagacctccaaagacctggtatcctctttcctggtgttcaagttcagagaggtgtctggagtaggggctgagcctggcctggatgggcagtgctgtgacaagtgtctaggatggccgggtatcctgcacagagctagaaggctgcctggcacgggtgaaagcagagctgctccctgaccctctgcccctccctcctccaccctggcctgctttagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggctgcccccatcacctctactgtctcctccctgggctaagcaggggagaagcgggctgggggtagcctggatgtgggccaagtccactgtcctccttggcggcaaaagcccattgaagaagaaccagcccagcctgccccctatcttgtcctggaatatttttggggttggaactcaaaaaaaaaaaaaaaaaa

SEQ ID NO: 32103 - DNA, 709 bp, Homo sapiens
cctccccccgcgccctgtgcctcctggggctacctgaagccggtgtcctgggagatctctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctg

SEQ ID NO: 32104 - DNA, 1603 bp, Homo sapiens
cggtggtgaggggctgccctacggtggttcccttaattgtgggccgccccccatccttgctgctggctgtggcacctcgctctgtgggctggtgccctcactgtgctgctctttgagaacactccctgtcccaaatctgagttgggaagttctcctgtgttccatctgcacggtggatggagagtccctttgtcttcccaattaaacaccctagccaagaaccctgaagtcctccctgcccccacccatgtccgccttttctttggctttggctttggtgagctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaatgga

SEQ ID NO: 32105 - DNA, 1604 bp, Homo sapiens
tggaggctgaggtactcacgggtggagaccactgcagccgcctttgtagattcagactccccgaacctttaacccttgctctggtctactgtccctctgtctcaagcagtcctccctccttctgcgctgcggcgcctttaaaccttcttggcccttgccccgccccgggtccgccccgtctgaggcgggaccctcctgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaatgga

SEQ ID NO: 32106 - DNA, 801 bp, Homo sapiens
agacagggcgtccgtctggagcagggactcagggactgagccccacccgcgggctccatcgctgagtcctcactggggcgaggggaaaaaagggcgtcggactttagctggctggccccgagtgaccccgggtcgtggcgccggccctgggccagctcgtgctcctgggctttcccgcgcgacccttcacttcctggttccaggagcacgtctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcag

SEQ ID NO: 32107 - DNA, 2777 bp, Homo sapiens
acataagtcacttaccaggtctgtccctgcggcatccagtctgtgggtcctgtcccatccatcctgacctgttccatctcagccccaggactcagtactgcggttgccaacactgctgccaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgctgttcatgccgaaatgcggcagatgacgactggggacctgaaccctctgactccaggggtcgagggtccagctctggcactcgaagacctggctcccggggctcagactcccgccggcctgtatcccggggcagcggtgtcaatgcagctggagatggcaccatccgagagggcatgctagtagtgaacggtgtggacttgctgagctcgcgctcggaccagaaccgccgagagcaccacacagacgagtatgagtacgacgagctgatagtgcgccgcgggcagcctttccatatgctcctcctcctgtcccggacctatgaatcctctgatcgcatcacccttgagttactcatcggaaacaaccccgaggtgggcaagggcacgcacgtgatcatcccagtgggcaaggggggcagtggaggctggaaagcccaggtggtcaaggccagtgggcagaatctgaacctgcgggtccacacttcccccaacgccatcatcggcaagtttcagttcacagtccgcacacaatcagacgctggggagttccagttgccctttgacccccgcaatgagatctacatcctcttcaacccctggtgcccagaggacattgtgtacgtggaccatgaggattggcggcaggagtatgttcttaatgagtctgggagaatttactacgggaccgaagcacagattggtgagcggacctggaactacggccagtttgaccacggggtgctggatgcctgcttatacatcctggaccggcgggggatgccatatggaggccgtggagacccagtcaatgtctcccgggtcatctctgccatggtgaactccctggatgacaatggagtcctgattgggaactggtctggtgattactcccgaggcaccaacccatcagcgtgggtgggcagcgtggagatcctgcttagctacctacgcacgggatattccgtcccctatggccagtgctgggtctttgctggcgtgaccaccacagtgctgcgctgcctgggtctggccacccgtactgtcaccaacttcaactccgcccacgacacagacacatcccttaccatggacatctacttcgacgagaacatgaagcccctggagcacctgaaccatgattctgtctggaacttccatgtgtggaacgactgctggatgaagaggccggatctgccctcgggctttgatgggtggcaggtggtggatgccacaccccaagagactagcagtggcatcttctgctgcggcccctgctctgtggagtccatcaagaatggcctggtctacatgaagtacgacacgcctttcatttttgctgaggtgaatagtgacaaggtgtactggcagcggcaggatgatggcagcttcaagattgtttatgtggaggagaaggccatcggcacactcattgtcacaaaggccatcagctccaacatgcgggaggacatcacctacctctataagcacccagaaggctcagacgcagagcggaaggcagtagagacagcagcagcccacggcagcaaacccaatgtgtatgccaaccggggctcagcggaggatgtggccatgcaggtggaggcacaggacgcggtgatggggcaggatctgatggtctctgtgatgctgatcaatcacagcagcagccgccgcacagtgaaactgcacctctacctctcagtcactttctatactggtgtcagtggtaccatcttcaaggagaccaagaaggaagtggagctggcaccaggggcctcggaccgtgtgaccatgccagtggcctacaaggaataccggccccatcttgtggaccagggggccatgctgctcaatgtctcaggccacgtcaaggagagcgggcaggtgctggccaagcagcacaccttccgtctgcgcaccccagacctctccctcacgttactgggagcagcagtggttggccaggagtgtgaagtacagattgtcttcaagaacccccttcccgtcaccctcaccaatgtcgtcttccggctcgaaggctctgggttacagaggcccaagatcctcaacgttggggacattggaggcaatgaaacagtgacactgcgccagtcgtttgtgcctgtgcgaccaggcccccgccagctcattgccagcttggacagcccacagctctcccaggtgcacggtgtcatccaggtggatgtggccccagcccctggggatgggggcttcttctcagacgctggaggtgacagtcacttaggagagaccatccctatggcatctcgaggtggagcttagccccgtgccaggagcaatgggactggagtcagatgagcaaggacattgccccaagataggggcacactacagagcagctccccaggagctcaggtggggagtccagggctcccggagggggagtccagggctcccggagagggagtcagtcttcacttgcactgggggaacagatgctaataaactgttttttaatgaa

SEQ ID NO: 32108 - DNA, 1581 bp, Homo sapiens
ggcatccagtctgtgggtcctgtcccatccatcctgacctgttccatctcagccccaggactcagtactgcggttgccaacactgctgccaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgctgttcatgccgaaatgcggcagatgacgactggggacctgaaccctctgactccaggggtcgagggtccagctctggaacttccatgtgtggaacgactgctggatgaagaggccggatctgccctcgggctttgatgggtggcaggtggtggatgccacaccccaagagactagcagtggcatcttctgctgcggcccctgctctgtggagtccatcaagaatggcctggtctacatgaagtacgacacgcctttcatttttgctgaggtgaatagtgacaaggtgtactggcagcggcaggatgatggcagcttcaagattgtttatgtggaggagaaggccatcggcacactcattgtcacaaaggccatcagctccaacatgcgggaggacatcacctacctctataagcacccagaaggctcagacgcagagcggaaggcagtagagacagcagcagcccacggcagcaaacccaatgtgtatgccaaccggggctcagcggaggatgtggccatgcaggtggaggcacaggacgcggtgatggggcaggatctgatggtctctgtgatgctgatcaatcacagcagcagccgccgcacagtgaaactgcacctctacctctcagtcactttctatactggtgtcagtggtaccatcttcaaggagaccaagaaggaagtggagctggcaccaggggcctcggaccgtgtgaccatgccagtggcctacaaggaataccggccccatcttgtggaccagggggccatgctgctcaatgtctcaggccacgtcaaggagagcgggcaggtgctggccaagcagcacaccttccgtctgcgcaccccagacctctccctcacgttactgggagcagcagtggttggccaggagtgtgaagtacagattgtcttcaagaacccccttcccgtcaccctcaccaatgtcgtcttccggctcgaaggctctgggttacagaggcccaagatcctcaacgttggggacattggaggcaatgaaacagtgacactgcgccagtcgtttgtgcctgtgcgaccaggcccccgccagctcattgccagcttggacagcccacagctctcccaggtgcacggtgtcatccaggtggatgtggccccagcccctggggatgggggcttcttctcagacgctggaggtgacagtcacttaggagagaccatccctatggcatctcgaggtggagcttagccccgtgccaggagcaatgggactggagtcagatgagcaaggacattgccccaagataggggcacactacagagcagctccccaggagctcaggtggggagtcca

SEQ ID NO: 32109 - DNA, 555 bp, Homo sapiens
agaactcggcagcaggagcctgtgagagcagagtcacttaccaggtctgtccctgcggcatccagtctgtgggtcctgtcccatccatcctgacctgttccatctcagccccaggactcagtactgcggttgccaacactgctgccaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgctgttcatgccgaaatgcggcagatgacgactggggacctgaaccctctgactccaggggtcgagggtccagctctggcactcgaagacctggctcccggggctcagactcccgccggcctgtatcccggggcagcggtgtcaatgcagctggagatggcaccatccgagagggcatgctagtagtgaacggtgtggacttgctgagctcgcgctcggaccagaaccgccgagagcaccacacagacgagtatgag

SEQ ID NO: 32110 - DNA, 580 bp, Homo sapiens
acagaactcggcagcaggagcctgtgagagcagaggtaggcagcctaagcttgggaccagaaggtcggccagacagggctgtgggtggaagggcctgcctgccccactgcccttgcagcttcttcatccgggagaaggggctcctcacatgcccagtctggtaggaatcagcctggtgccaggggccatcacagcggtggctcccaccaaagcccagcctaagcccccagacctcacccctgctccctccctagcatcttctccccatttcccgcccagaggcctggcctcttctctccgccccctacagcagtttggcccctccctcccacataagtcacttaccaggtctgtccctgcggcatccagtctgtgggtcctgtcccatccatcctgacctgttccatctcagccccaggactcagtactgcggttgccaacactgctgccaggcatgatggatgggccacgttccgatgtgggccgttggggtggcaaccccttgcagccccctaccacgccatctccagagccagagccagagccagacggacgctctcgcagaggaggaggccgttcc

SEQ ID NO: 32111 - DNA, 527 bp, Homo sapiens
gtcggcctgtttttactgtcttctgctaggcggcccatgggcagagctgggacactagtgggaaggaaggaaagaaggaagaaggccctggctgacgggcctgaggacaagacccaaggagagcctccctgaagatgcctagcctcctcctctctaccttgggatcgccttggtgccatcctcagtgtttccccagtgacggggtggagtaaggatgcacacagcacaggtgcctgagccggttggtctggattcccaggaagaattccaggttggagaaaagggaatcctctagtccaactgagcagagactcctctcagtgagagaaaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgctgttcatgccgaaatgcggcagatgacgactggggacctgaacc

SEQ ID NO: 32112 - DNA, 562 bp, Homo sapiens
taggcggcccatgggcagagctgggacactagtgggaaggaaggaaagaaggaagaaggccctggctgacgggcctgaggacaagacccaaggagagcctccctgaagatgcctagcctcctcctctctaccttgggatcgccttggtgccatcctcagtgtttccccagtgacggggtggagtaaggatgcacacagcacaggtgcctgagccggttggtctggattcccaggaagaattccaggttggagaaaagggaatcctctagtccaactgagcagagactcctctcagtgagagaaaggtctgtccctgcggcatccagtctgtgggtcctgtcccatccatcctgacctgttccatctcagccccaggactcagtactgcggttgccaacactgctgccaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgct

SEQ ID NO: 32113 - DNA, 469 bp, Homo sapiens
acccccgggcaggttctggtgcttggagctggacaagaaaaggcagtgtgggtgtggagggctccctgccagttcctggggcctctctgtccccactccccacggcacctccctgcctgatgcatcaccaaacagcccctcctggattctgtttccttgtgtcttcttgtcggcctgtttttactgtcttctgctaggcggcccatgggcagagctgggacactagtgggaaggaaggaaagaaggaagaaggccctggctgacgggcctgaggacaagacccaaggagagcctccctgaagatgcctagcctcctcctctctaccttgggatcgccttggtgccatcctcagtgtttccccagtgacggggtggagtaaggatgcacacagcacaggtgcctgagccggttggtctggattcccaggaagaattccaggcatgatggatgggccacgttccgatgtgg

SEQ ID NO: 32114 - DNA, 3996 bp, Homo sapiens
actgggcaatgggtggcctcccaggtcgccgccttcccgcggggccccgcccccggcccgccccaaagcgggctataagttagcgccgctctccgcctcggcagtgccagccgccagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 32115 - DNA, 1018 bp, Homo sapiens
acagtggatccggaagcacaggagaccaagagaccagagataccaggatgagagataggacccctggttgccaggttcgagaagtcctaggctgagtccctggaaatgccagccgccagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgc

SEQ ID NO: 32116 - DNA, 693 bp, Homo sapiens
gttttggaaaaagtgccagggaagccccgtgggcctctgtctctccgggaacccttcccgctcagggctcacagtggatccggaagcacaggagaccaagagaccagagataccaggatgagagataggacccctggttgccagtgccagccgccagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgt

SEQ ID NO: 32117 - DNA, 2157 bp, Homo sapiens
agtgccagccgccagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccgcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgag

SEQ ID NO: 32118 - DNA, 2041 bp, Homo sapiens
agtgccagccgccagtggtcgcacttggagggtctcgccgccagtggaaggagccaccgcccccgcccgaccatggccgagggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttctt

SEQ ID NO: 32119 - DNA, 2642 bp, Homo sapiens
gtctgtcagcactgtccgtgccattcccagaggagcctgagaagaggcagaggaaggcgaaacatggctgctctaggagtccagagtatcaactggcagacggccttcaaccgacaagcgcatcacacagacaagttctccagccaggagctcatcttgcggagaggccaaaacttccaggtcttaatgatcatgaacaaaggccttggctctaacgaaagactggagttcattgtctccacagggccttacccctcagagtcggccatgacgaaggctgtgtttccactctccaatggcagtagtggtggctggagtgcggtgcttcaggccagcaatggcaatactctgactatcagcatctccagtcctgccagcgcacccataggacggtacacaatggccctccagatcttctcccagggcggcatctcctctgtgaaacttgggacgttcatactgctttttaacccctggctgaatgtggatagcgtctttatgggtaaccacgctgagagagaagagtatgttcaggaagatgccggcatcatctttgtgggaagcacaaaccgaattggcatgattggctggaactttggacagtttgaagaagacattctcagcatctgcctctcaatcttggataggagtctgaatttccgccgtgacgctgctactgatgtggccagcagaaatgaccccaaatacgttggccgggtgctgagtgccatgatcaatagcaatgatgacaatggtgtgcttgctgggaattggagcggcacttacaccggtggccgggacccaaggagctggaacggcagcgtggagatcctcaaaaattggaaaaaatctggcttcagcccagtccgatatggccagtgctgggtctttgctgggaccctcaacacagcgctgcggtctttggggattccttcccgggtgatcaccaacttcaactcagctcatgacacagaccgaaatctcagtgtggatgtgtactacgaccccatgggaaaccccctggacaagggtagtgatagcgtatggaatttccatgtctggaatgaaggctggtttgtgaggtctgacctgggcccctcgtacggtggatggcaggtgttggatgctaccccgcaggaaagaagccaaggggtgttccagtgcggccccgcttcggtcattggtgttcgagagggtgatgtgcagctgaacttcgacatgccctttatcttcgcggaggttaatgccgaccgcatcacctggctgtacgacaacaccactggcaaacagtggaagaattccgtgaacagtcacaccattggcaggtacatcagcaccaaggcggtgggcagcaatgctcgcatggacgtcacggacaagtacaagtacccagaaggctctgaccaggaaagacaagtgttccaaaaggctttggggaaacttaaacccaacacgccatttgccgcgacgtcttcaatgggtttggaaacagaggaacaggagcccagcatcatcgggaagctgaaggtcgctggcatgctggcagtaggcaaagaagtcaacctggtcctactgctcaaaaacctgagcagggatacgaagacagtgacagtgaacatgacagcctggaccatcatctacaacggcacgcttgtacatgaagtgtggaaggactctgccacaatgtccctggaccctgaggaagaggcagaacatcccataaagatctcgtacgctcagtatgagaagtacctgaagtcagacaacatgatccggatcacagcggtgtgcaaggtcccagatgagtctgaggtggtggtggagcgggacatcatcctggacaaccccaccttgaccctggaggtgctgaacgaggctcgtgtgcggaagcctgtgaacgtgcagatgctcttctccaatccactggatgagccggtgagggactgcgtgctgatggtggagggaagcggcctgctgttgggtaacctgaagatcgacgtgccgaccctagggcccaaggaggggtcccgggtccgttttgatatcctgccctcccggagtggcaccaagcaactgctcgccgacttctcctgcaacaagttccctgcaatcaaggccatgttgtccatcgatgtagccgaatgaagggcgctggtggcctcccgtacaaacttggacaacacggagcagggagagctcaccatggaatgaaccccccgcccatgctgtccggcctgggaaaccctctccatctcccaaggctgccagacatggacctccaggctccagcacatccccctctcctctcccccaggttggggctgggtccaccctgtcctatgacttgatcacttttgcacattccctggccgcttctccccagagctgcctgctctgtgagccccacagccctgctcattcctcacgcccttcaatgctgcaggatggactggcccctgacccagggactctccaaacgggatacaggagagaagctggtctagactgtttgctgatccccaacctgcacggggcattcctgcttctctctcaggccaccacagagggcaggggatggttagtcacctgccccagcactcacaccctaactcaaaataaatgttaaataagtgcgatcacac

SEQ ID NO: 32120 - DNA, 1796 bp, Homo sapiens
gtctgtcagcactgtccgtgccattcccagaggagcctgagaagaggcagaggaaggcgaaacatggctgctctaggagtccagagtatcaactggcagacggccttcaaccgacaagcgcatcacacagacaagttctccagccaggagctcatcttgcggagaggccaaaacttccaggtcttaatgatcatgaacaaaggccttggctctaacgaaagactggagttcattgtctccacagggccttacccctcagagtcggccatgacgaaggctgtgtttccactctccaatggcagtagtggtggctggagtgcggtgcttcaggccagcaatggcaatactctgactatcagcatctccagtcctgccagcgcacccataggacggtacacaatggccctccagatcttctcccagggcggcatctcctctgtgaaacttgggacgttcatactgctttttaacccctggctgaatgtggatagcgtctttatgggtaaccacgctgagagagaagagtatgttcaggaagatgccggcatcatctttgtgggaagcacaaaccgaattggcatgattggctggaactttggacagtttgaagaagacattctcagcatctgcctctcaatcttggataggagtctgaatttccgccgtgacgctgctactgatgtggccagcagaaatgaccccaaatacgttggccgggtgctgagtgccatgatcaatagcaatgatgacaatggtgtgcttgctgggaattggagcggcacttacaccggtggccgggacccaaggagctggaacggcagcgtggagatcctcaaaaattggaaaaaatctggcttcagcccagtccgatatggccagtgctgggtctttgctgggaccctcaacacagcgctgcggtctttggggattccttcccgggtgatcaccaacttcaactcagctcatgacacagaccgaaatctcagtgtggatgtgtactacgaccccatgggaaaccccctggacaagggtagtgatagcgtatggaatttccatgtctggaatgaaggctggtttgtgaggtctgacctgggcccctcgtacggtggatggcaggtgttggatgctaccccgcaggaaagaagccaaggggtgttccagtgcggccccgcttcggtcattggtgttcgagagggtgatgtgcagctgaacttcgacatgccctttatcttcgcggaggttaatgccgaccgcatcacctggctgtacgacaacaccactggcaaacagtggaagaattccgtgaacagtcacaccattggcaggtacatcagcaccaaggcggtgggcagcaatgctcgcatggacgtcacggacaagtacaagtacccagaaggctctgaccaggaaagacaagtgttccaaaaggctttggggaaacttaaacccaacacgccatttgccgcgacgtcttcaatgggtttggaaacagaggaacaggagcccagcatcatcgggaagctgaaggtcgctggcatgctggcagtaggcaaagaagtcaacctggtcctactgctcattcctcacgcccttcaatgctgcaggatggactggcccctgacccagggactctccaaacgggatacaggagagaagctggtctagactgtttgctgatccccaacctgcacggggcattcctgcttctctctcaggccaccacagagggcaggggatggttagtcacctgccccagcactcacaccctaactcaaaataaatgttaaataagtgcg

SEQ ID NO: 32121 - DNA, 3388 bp, Homo sapiens
gactgtgtggaagcaccaggcatcagagatagagtcttccctggcattgcaggagagaatctgaagggatgatggatgcatcaaaagagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagggccgaatcctagcatcgccaaacacaccctggtggtgctcgacccgaggacgccctcagaccactacaactggcaggcaacccttcaaaatgagtctggcaaagaggtcacagtggctgtcaccagttcccccaatgccatcctgggcaagtaccaactaaacgtgaaaactggaaaccacatccttaagtctgaagaaaacatcctataccttctcttcaacccatggtgtaaagaggacatggttttcatgcctgatgaggacgagcgcaaagagtacatcctcaatgacacgggctgccattacgtgggggctgccagaagtatcaaatgcaaaccctggaactttggtcagtttgagaaaaatgtcctggactgctgcatttccctgctgactgagagctccctcaagcccacagataggagggaccccgtgctggtgtgcagggccatgtgtgctatgatgagctttgagaaaggccagggcgtgctcattgggaattggactggggactacgaaggtggcacagccccatacaagtggacaggcagtgccccgatcctgcagcagtactacaacacgaagcaggctgtgtgctttggccagtgctgggtgtttgctgggatcctgactacagtgctgagagcgttgggcatcccagcacgcagtgtgacaggcttcgattcagctcacgacacagaaaggaacctcacggtggacacctatgtgaatgagaatggcgagaaaatcaccagtatgacccacgactctgtctggaatttccatgtgtggacggatgcctggatgaagcgaccggatctgcccaagggctacgacggctggcaggctgtggacgcaacgccgcaggagcgaagccagggtgtcttctgctgtgggccatcaccactgaccgccatccgcaaaggtgacatctttattgtctatgacaccagattcgtcttctcagaagtgaatggtgacaggctcatctggttggtgaagatggtgaatgggcaggaggagttacacgtaatttcaatggagaccacaagcatcgggaaaaacatcagcaccaaggcagtgggccaagacaggcggagagatatcacctatgagtacaagtatccagaaggctcctctgaggagaggcaggtcatggatcatgccttcctccttctcagttctgagagggagcacagacgacctgtaaaagagaactttcttcacatgtcggtacaatcagatgatgtgctgctgggaaactctgttaatttcaccgtgattcttaaaaggaagaccgctgccctacagaatgtcaacatcttgggctcctttgaactacagttgtacactggcaagaagatggcaaaactgtgtgacctcaataagacctcgcagatccaaggtcaagtatcagaagtgactctgaccttggactccaagacctacatcaacagcctggctatattagatgatgagccagttatcagaggtttcatcattgcggaaattgtggagtctaaggaaatcatggcctctgaagtattcacgtctttccagtaccctgagttctctatagagttgcctaacacaggcagaattggccagctacttgtctgcaattgtatcttcaagaataccctggccatccctttgactgacgtcaagttctctttggaaagcctgggcatctcctcactacagacctctgaccatgggacggtgcagcctggtgagaccatccaatcccaaataaaatgcaccccaataaaaactggacccaagaaatttatcgtcaagttaagttccaaacaagtgaaagagattaatgctcagaagattgttctcatcaccaagtagccttgtctgatgctgtggagccttagttgagatttcagcatttcctaccttgtgcttagctttcagattatggatgattaaatttgatgacttatatgagggcagattcaagagccagcaggtcaaaaaggccaacacaaccataagcagccagacccacaaggccaggtcctgtgctatcacagggtcacctcttttacagttagaaacaccagccgaggccacagaatcccatccctttcctgagtcatggcctcaaaaatcagggccaccattgtctcaattcaaatccatagatttcgaagccacagagtctctccctggagcagcagactatgggcagcccagtgctgccacctgctgacgacccttgagaagctgccatatcttcaggccatgggttcaccagccctgaaggcacctgtcaactggagtgctctctcagcactgggatgggcctgatagaagtgcattctcctcctattgcctccattctcctctctctatccctgaaatccaggaagtccctctcctggtgctccaagcagtttgaagcccaatctgcaaggacatttctcaagggccatgtggttttgcagacaaccctgtcctcaggcctgaactcaccatagagacccatgtcagcaaacggtgaccagcaaatcctcttcccttattctaaagctgccccttgggagactccagggagaaggcattgcttcctccctggtgtgaactctttctttggtattccatccactatcctggcaactcaaggctgcttctgttaactgaagcctgctccttcttgttctgccctccagagatttgctcaaatgatcaataagctttaaattaaactctacttcaagaaaactctgtggtccctgagtccttttttctttatgccaataagcttcttaaatgtgctggcggtttatgcagtcacttggggagccatggaatcctttgatctccccaggcaaggtgctctgaggagttggcttctttattgtctgttcagtacatccaacccctctctcaaaggctgtcaccccaactggatacacaccctggcaaaggcacgtagcttgaatgagggttattttgtgtctaattcacaggagagtcatgggtgggatacctgtcatcctctgcctttccagctgtccaagtgaaaaaaacctcaatcctggtcacccttgcccaagttgcccacatccctggcatacagtaggtgttcaataaatgtttattgaaggaaa

SEQ ID NO: 32122 - DNA, 2767 bp, Homo sapiens
cagctaccatggcccaagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactggaccgctgccagacctggccttggggactcgggctgtgttcagcctggcacgccatcacagccccagcccctggattgcctggctggagaccaatggggccacctccacagaggtgagcttgtgcgctcctcccacggcggccgtgggtcggtacctcttgaaaatccacatcgactccttccaggggtctgtgacggcctaccagctaggggagttcatcctgcttttcaatccctggtgcccagaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgttctaggagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgaatttcaagcttcaggaaaaggagcaagttcaaatgcaagctgcgccattccccaccacaacagaggcttcacagggctccagcaagagccacagaggggatgacgtgttcattttctgtctctcctgactccactagaaatttaagctccatgagggcaaagactttgctttgtttactacccctatactcagaaccatttctggcatatgctaggcactcaacaaatattttttgaatgaatgaataggagactccagcatccagagaacaggtaggaaatgtctatggatggatatttccctggaccatttgcacagctcccctggactcttttcagggcccagggattccactgtgtcccatccagagattccaggattccagtctcctatccagaagcgtgatttggcacagaggtcagaggatactggtaggacttggccatgacttaactgccccctgccccagatatccaggaaagaaaaagacaggctgaacagctcactgttgttttgttgttgcgaaagctaattccctagtatgaataaacttcagaccttgctctc

SEQ ID NO: 32123 - DNA, 2521 bp, Homo sapiens
cagctaccatggcccaagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactgaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgttctaggagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgaatttcaagcttcaggaaaaggagcaagttcaaatgcaagctgcgccattccccaccacaacagaggcttcacagggctccagcaagagccacagaggggatgacgtgttcattttctgtctctcctgactccactagaaatttaagctccatgagggcaaagactttgctttgtttactacccctatactcagaaccatttctggcatatgctaggcactcaacaaatattttttgaatgaatgaataggagactccagcatccagagaacaggtaggaaatgtctatggatggatatttccctggaccatttgcacagctcccctggactcttttcagggcccagggattccactgtgtcccatccagagattccaggattccagtctcctatccagaagcgtgatttggcacagaggtcagaggatactggtaggacttggccatgacttaactgccccctgccccagatatccaggaaagaaaaagacaggctgaacagctcactgttgttttgttgttgcgaaagctaattccctagtatgaataaacttcagaccttgctctc

SEQ ID NO: 32124 - DNA, 2756 bp, Homo sapiens
gctcaagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactggaccgctgccagacctggccttggggactcgggctgtgttcagcctggcacgccatcacagccccagcccctggattgcctggctggagaccaatggggccacctccacagaggtgagcttgtgcgctcctcccacggcggccgtgggtcggtacctcttgaaaatccacatcgactccttccaggggtctgtgacggcctaccagctaggggagttcatcctgcttttcaatccctggtgcccagaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgttctaggagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgaatttcaagcttcaggaaaaggagcaagttcaaatgcaagctgcgccattccccaccacaacagaggcttcacagggctccagcaagagccacagaggggatgacgtgttcattttctgtctctcctgactccactagaaatttaagctccatgagggcaaagactttgctttgtttactacccctatactcagaaccatttctggcatatgctaggcactcaacaaatattttttgaatgaatgaataggagactccagcatccagagaacaggtaggaaatgtctatggatggatatttccctggaccatttgcacagctcccctggactcttttcagggcccagggattccactgtgtcccatccagagattccaggattccagtctcctatccagaagcgtgatttggcacagaggtcagaggatactggtaggacttggccatgacttaactgccccctgccccagatatccaggaaagaaaaagacaggctgaacagctcactgttgttttgttgttgcgaaagctaattccctagtatgaataaacttcagaccttgctctc

SEQ ID NO: 32125 - DNA, 2292 bp, Homo sapiens
actgtcctgacggtgcacacactgctgtgtggaggaacagaggagtccagctggccttcacatggcagggatcagagtcaccaaggtggactggcagcggtcgaggaatggcgctgcccaccacacccaggagtacccctgccctgagctggtggttcgcaggggccagtcgttcagcctcacgctggagctgagcagagccctggactgtgaggagatcctcatcttcacgatggagacaggaccccgggcttctgaggccctccacaccaaagctgtgttccagacatcggagctggagcggggtgagggctggacagcagcaagggaggctcagatggagaaaactctgaccgtcagtctcgccagccctcccagtgctgtcattggccgctacctgctgagcatcaggctttcctctcaccgcaaacacagcaaccggaggctgggcgagtttgttctccttttcaacccatggtgtgcagaggacgatgtgtttctggcctcagaggaggagagacaggagtacgtgctcagcgacagcggcatcatcttccgaggcgtggagaagcacatacgagcccagggctggaactacgggcagtttgaggaggacatcctgaacatctgcctctccatcctggatcgaagccccggtcaccaaaacaacccagccaccgacgtgtcctgccgccacaaccccatctacgtcaccagggtcatcagtgccatggtgaacagcaacaacgaccgaggtgtggtgcaaggacagtggcagggcaagtacggcggcggcaccagcccgctgcactggcgcggcagcgtggccattctgcagaagtggctcaagggcaggtacaagccagtcaagtacggccagtgctgggtcttcgccggagtcctgtgcacagtcctcaggtgcttggggatagccacacgggtcgtgtccaacttcaactcagcccacgacacagaccagaacctgagtgtggacaaatacgtggactccttcgggcggaccctggaggacctgacagaagacagcatgtggaatttccatgtctggaatgagagctggtttgcccggcaggacctaggcccctcttacaatggctggcaggttctggatgccaccccccaggaggagagtgaaggtgtgttccggtgcggcccagcctcagtcaccgccatccgcgagggtgatgtgcacctggctcacgatggccccttcgtgtttgcggaggtcaacgccgactacatcacctggctgtggcacgaggatgagagccgggagcgtgtatactcaaacacgaagaagattgggagatgcatcagcaccaaggcggtgggcagtgactcccgcgtggacatcactgacctctacaagtatccggaagggtcccggaaagagaggcaggtgtacagcaaggcggtgaacaggctgttcggcgtggaagcctctggaaggagaatctggatccgcagggctgggggtcgctgtctctggcgtgacgacctcctggagcctgccaccaagcccagcatcgctggcaagttcaaggtgctagagcctcccatgctgggccacgacctgagactggccctgtgcttggccaacctcacctcccgggcccagcgggtgagggtcaacctgagcggtgccaccatcctctatacccgcaagccagtggcagagatcctgcatgaatcccacgccgtgaggctggggccgcaagaagagaagagaatcccaattacaatatcttactctaagtataaagaagacctgacagaggacaagaagatcctgttggctgccatgtgccttgtcaccaaaggagagaagcttctggtggagaaggacattactctagaggacttcatcaccatcaaggttctgggcccagccatggtgggagtggcagttacagtggaagtgacagtagtcaaccccctcatagagagagtgaaggactgtgcgctgatggtggagggcagcggccttctccaggaacagctcagcatcgacgtgcctaccctggagcctcaggagagggcctcagtccagtttgacatcaccccctccaaaagtggcccaaggcagctgcaggtggaccttgtaagccctcacttcccggacatcaagggctttgtgatcgtccatgtggccactgccaagtgatggatcatgagggactgagaggggtggatttggcccctgtcctcctcctgcccattctttgtctcttccacatgggagccaggaggcctcagttaatcctgcctcaacct

SEQ ID NO: 32126 - DNA, 2158 bp, Homo sapiens
actgtcctgacggtgcacacactgctgtgtggaggaacagaggagtccagctggccttcacatggcagggatcagagtcaccaaggtggactggcagcggtcgaggaatggcgctgcccaccacacccaggagtacccctgccctgagctggtggttcgcaggggccagtcgttcagcctcacgctggagctgagcagagccctggactgtgaggagatcctcatcttcacgatggagacaggaccccgggcttctgaggccctccacaccaaagctgtgttccagacatcggagctggagcggggtgagggctggacagcagcaagggaggctcagatggagaaaactctgaccgtcagtctcgccagccctcccagtgctgtcattggccgctacctgctgagcatcaggctttcctctcaccgcaaacacagcaaccggaggctgggcgagtttgttctccttttcaacccatggtgtgcagaggacgatgtgtttctggcctcagaggaggagagacaggagtacgtgctcagcgacagcggcatcatcttccgaggcgtggagaagcacatacgagcccagggctggaactacgggcagtttgaggaggacatcctgaacatctgcctctccatcctggatcgaagccccggtcaccaaaacaacccagccaccgacgtgtcctgccgccacaaccccatctacgtcaccagggtcatcagtgccatggtgaacagcaacaacgaccgaggtgtggtgcaaggacagtggcagggcaagtacggcggcggcaccagcccgctgcactggcgcggcagcgtggccattctgcagaagtggctcaagggcaggtacaagccagtcaagtacggccagtgctgggtcttcgccggagtcctgtgcacagtcctcaggtgcttggggatagccacacgggtcgtgtccaacttcaactcagcccacgacacagaccagaacctgagtgtggacaaatacgtggactccttcgggcggaccctggaggacctgacagaagacagcatgtggaatttccatgtctggaatgagagctggtttgcccggcaggacctaggcccctcttacaatggctggcaggttctggatgccaccccccaggaggagagtgaaggtgtgttccggtgcggcccagcctcagtcaccgccatccgcgagggtgatgtgcacctggctcacgatggccccttcgtgtttgcggaggtcaacgccgactacatcacctggctgtggcacgaggatgagagccgggagcgtgtatactcaaacacgaagaagattgggagatgcatcagcaccaaggcggtgggcagtgactcccgcgtggacatcactgacctctacaagtatccggaagggtcccggaaagagaggcaggtgtacagcaaggcggtgaacaggctgttcggcgtggaagcctctggaaggagaatctggatccgcagggctgggggtcgctgtctctggcgtgacgacctcctggagcctgccaccaagcccagcatcgctggcaagttcaaggtgctagagcctcccatgctgggccacgacctgagactggccctgtgcttggccaacctcacctcccgggcccagcgggtgagggtcaacctgagcggtgccaccatcctctatacccgcaagccagtggcagagatcctgcatgaatcccacgccgtgaggctggggccgcaagaagagaagagaatcccaattacaatatcttactctaagtataaagaagacctgacagaggacaagaagatcctgttggctgccatgtgccttgtcaccaaaggagagaagcttctggtggagaaggacattactctagaggacttcatcaccatcaagcgtgcctaccctggagcctcaggagagggcctcagtccagtttgacatcaccccctccaaaagtggcccaaggcagctgcaggtggaccttgtaagccctcacttcccggacatcaagggctttgtgatcgtccatgtggccactgccaagtgatggatcatgagggactgagaggggtggatttggcccctgtcctcctcctgcccattctttgtctcttccacatgggagccaggaggcctcagttaatcctgcctcaacct

SEQ ID NO: 32127 - DNA, 2312 bp, Homo sapiens
gggagatggatcaggtggcaaccttgcggcttgagtctgtcgacctgcagagctccaggaacaacaaggagcaccacacgcaggagatgggcgtcaagcggctcactgtgcgccgcggccagcccttctacctccggctgagcttcagccgacccttccagtcccagaacgaccacatcacctttgtggctgagaccggacccaagccgtcagagctgctggggacccgagccacattcttcctcacccgggtccagcccgggaatgtctggagcgcttctgatttcaccattgactccaactctctccaagtttcccttttcacaccagccaatgcagttattggccattacactctgaaaatagagatctctcagggccaaggtcacagtgtgacttacccgctgggaactttcatcctactttttaacccttggagtccagaggacgacgtctacctgccaagtgaaatactgctgcaggagtatatcatgcgagattatggctttgtttacaagggtcatgaaagattcatcacctcctggccctggaactacgggcagtttgaagaggacatcatagacatctgctttgagatcctgaacaagagcctgtatcacttaaagaacccggccaaagactgttcccagcggaacgacgtggtgtatgtgtgcagggtggtgagtgccatgatcaacagcaacgatgacaatggcgtgctgcaggggaactggggcgaggactactccaaaggggtcagtcctctggagtggaagggcagtgtggccatcctacagcagtggtcagccaggggcgggcagcctgtgaagtacggacagtgctgggtcttcgcctctgttatgtgcaccgtaatgagatgcttaggtgttccaacccgtgttgtttccaatttccgttccgcgcacaacgtggataggaacttgaccatcgatacgtactatgaccgaaatgccgagatgctgtcaactcagaaacgagacaaaatatggaacttccacgtctggaatgagtgctggatgatccggaaagatctcccaccaggatacaacgggtggcaggttctggaccccactccccagcagaccagcagtgggctgttctgctgtggccctgcctctgtgaaggccatcagggaaggggatgtccacctggcctatgacaccccttttgtgtatgccgaggtgaacgccgatgaagtcatttggctccttggggatggccaggcccaggaaatcctggcccacaacaccagttccatcgggaaggagatcagcactaagatggtggggtcagaccagcgccagagcatcaccagctcctacaagtacccagaaggatcccctgaggagagagctgtcttcatgaaggcttctcggaaaatgctgggcccccaaagagcttctttgcccttcctggatctcctggagtctgggggtcttagggatcagccagcgcagctgcagcttcacctggccaggatacccgagtggggccaggacctgcagctgctgctgcgtatccagagggtgccagacagcacccaccctcgggggcccatcggactggtggtgcgcttctgtgcacaggccctgctgcatgggggtggtacccagaagcccttctggaggcacacagtgcggatgaacctggactttgggaaggagacacagtggccgctcctcctgccctacagcaattacagaaacaagctaacggacgaaaagctcatccgcgtgtctggcatcgcggaggttgaagagacagggaggtccatgctggtcctaaaagatatctgtctggagcctccccacttgtctattgaggtgtctgagagggctgaggtgggcaaggcgctgagagtccatgtcaccctcaccaacaccttaatggtggctctgagcagctgcacgatggtgctggaaggaagcggcctcatcaatgggcagatagcaaaggaccttgggactctggtggccggacacaccctccaaattcaactggacctctacccgaccaaagctggaccccgccagctccaggttctcatcagcagcaacgaggtcaaggagatcaaaggctacaaggacatcttcgtcactgtggctggggctccctgagacccgccctccagctgccctccctggcacccctgccccacctggctcctttctactcctggctatgtcgtcttggctccacctctgtcctctctctagcctgcctgggaatgaatgaagctctgttagaaacaccgtgtgctttgggaagagacaataaagatgtctttattt

SEQ ID NO: 32128 - DNA, 5847 bp, Homo sapiens
gtaaggtctcggaagtacgaggcggaggggacgaaaaacggggggccagactgttgtggctgtggtggagacgagaaaccaggaagaagaggctcgcctcccactcggcgacagtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaagggacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatcttttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgacttttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgatcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtggatgagggtgagctggctgaggcatcgctcaagctggggggtggtgtgtaagaagcacgtggagccacaagaggcacctcctatagtcagctaagggcttccctttctgcgcccagcttttgggtgaagggtgatttctattagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaatgg

SEQ ID NO: 32129 - DNA, 6489 bp, Homo sapiens
ttcccacatgggagagaccagagcacagcacgtttgtgtacggccaggagggaaccacgaaaaaagcagaggatagaaacgcaagcacacgatggtggtggccaagaggagcctgcccctagtgacctcacttccgcggccagtgcgagaggcgagggagctccagctctgcctgtaaggtctcggaagtacgaggcggaggggacgaaaaacggggggccagactgttgtggctgtggtggagacgagaaaccaggaagaagaggctcgcctcccactcggcgacagtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaagggacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatcttttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgacttttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgatcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtggatgagggtgagctggctgaggcatcgctcaagctggggggtggtgtgtaagaagcacgtggagccacaagaggcacctcctatagtcagctaagggcttccctttctgcgcccagcttttgggtgaagggtgatttctattagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaatgg

SEQ ID NO: 32130 - DNA, 6138 bp, Homo sapiens
gtaaggtctcggaagtacgaggcggaggggacgaaaaacggggggccagactgttgtggctgtggtggagacgagaaaccaggaagaagaggctcgcctcccactcggcgacagtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaagggacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatcttttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgacttttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgatcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtggatgagggtgagctggctgaggcatcgctcaagctggggggtggtgtgtaagaagcacgtggagccacaagaggcacctcctatagtcagctaagggcttccctttctgcgcccagcttttgggtgaagggtgatttctattagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaa

SEQ ID NO: 32131 - DNA, 2235 bp, Homo sapiens
agaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaagggacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagatcttttttcccctaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaa

SEQ ID NO: 32132 - DNA, 1263 bp, Homo sapiens
tgctccggggactgcttttgccagtacccagaatcagtgctcaggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcgggtaggtaactttccaggccccatggaagaaccctaaagcctgtttggaaacgagggtatgagtggattatgttttcagtagctcaaccaagacctcaaatcaaaacaagctatgaacaaattgtctaaaaaatgtctgtcatgggagggctgtggtgaagaacagagaaacatattctaaatgtcctgtgaagtgggaaattctatgaaagctacacggataataaaaagggtgaggaaaagagagga

SEQ ID NO: 32133 - DNA, 4105 bp, Homo sapiens
ccgaagggcgtccacagcgactcctgctagtgcagggcagctgctgccagggccgggcccgggaccccacggaggcggggagaccactcttctcccacacgagcccagctctcccttcgagtagcaaccgccttcaagctcacaagcacccgtgggcctggggtgtgcctgcgtctagctggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatgctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaactggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtttggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacttctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaatgtttgaaagatcttccatttctaggaaccccagtcctgcttctccgcaatggcacatgcttccactccatccatactggcatcctcaaataaacagatatgtatacatatata

SEQ ID NO: 32134 - DNA, 2766 bp, Homo sapiens
ccacaacttcgatcttggcacctgcggcctcccctgccttttctccggtggggatgaggctgctgtgtgggtgtgggggtgactcacacgggccacgtgggtgggcgggtgctgcagctgtggctggtgggcgtggcctgcctggcgccgagggcaggtggctcagccagttctgcctctgacgcctcattccagccatccctctgcctgcaatgagagcttcccgccgcctcagccacagtcccacccgggggccttgggccccagacatgcggtgatctcagggcaagggttgccacgaccacccagaacctcaccagccatgaaagcccaccccaaggagatggtgcctctcatgggcaagagagttgctgcccccagtgggaaccctgccatcctgccagagaagaggccggcggagatcacccccacaaagaagagtgcacacttcttcctggagatagaagggtttgaacccaaccccacagttgccaagacctctcctcctgtcttctccaagcccatggattccaacatccggcagtgcatctctggtaactgtgatgacatggactccccccagtctcctcaggatgatgtgacagagaccccatccaatcccaacagccccagtgcacagctggccaaggaagagcagaggaggaaaaagaggcggctgaagaagcgcatctttgcagccgtgtctgagggctgcgtggaggagttggtagagttgctggtggagctgcaggagctttgcaggcggcgccatgatgaggatgtgcctgacttcctcatgcacaagctgacggcctccgacacggggaagacctgcctgatgaaggccttgttaaacatcaaccccaacaccaaggagatagtgcggatcctgcttgcctttgctgaagagaacgacatcctgggcaggttcatcaacgccgagtacacagaggaggcctatgaagggcagacggcgctgaacatcgccatcgagcggcggcagggggacatcgcagccctgctcatcgccgccggcgccgacgtcaacgcgcacgccaagggggccttcttcaaccccaagtaccaacacgaaggcttctacttcggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttttttatccaagctgtgcttgtgatactgtctgtcttcttgtacttgtttgcctacaaagagtacctcgcctgcctcgtgctggccatggccctgggctgggcgaacatgctctactatacgcggggtttccagtccatgggcatgtacagcgtcatgatccagaaggtcattttgcatgatgttctgaagttcttgtttgtatatatcgtgtttttgcttggatttggagtagccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagatttcaacaaaatccaagattcttccaggaacaacagcaaaaccactctcaatgcatttgaagaagtcgaggaattcccggaaacctcggtgtagaagcggaacccagagctggtgtgcgcgtgcgctgtctggcgctgcaggcggagtcaccgactctgtgcaga

SEQ ID NO: 32135 - DNA, 5223 bp, Homo sapiens
actacaaaagtagcgcgggcctgagaactccttccagaagttctccagggcttccgcagagcgactttttcgctgcctgtgagctgcagcgcgggagagctcgggctcgcgcggaccccagcgcctggcaggctgacagcgctctctcgccccaggtgcccgcgcgcgtggtgagcagctgcaccaggtggcgtccggggtggggtcaatgaagcgcagcctgaggaagatgtggcgccctggagaaaagaaggagccccagggcgttgtctatgaggatgtgccggacgacacggaggatttcaaggaatcgcttaaggtggtttttgaaggaagtgcatatggattacaaaactttaataagcaaaagaaattaaaaagatgtgacgatatggacaccttcttcttgcattatgctgcagcagaaggccaaattgagctaatggagaagatcaccagagattcctctttggaagtgctgcatgaaatggatgattatggaaatacccctctgcattgtgctgtagaaaaaaaccaaattgaaagcgttaagtttcttctcagcagaggagcaaacccaaatctccgaaacttcaacatgatggctcctctccacatagctgtgcagggcatgaataatgaggtgatgaaggtcttgcttgagcatagaactattgatgttaatttggaaggagaaaatggaaacacagctgtgatcattgcgtgcaccacaaataatagcgaagcattgcagattttgcttaaaaaaggagctaagccatgtaaatcaaataaatggggatgtttccctattcaccaagctgcattttcaggttccaaagaatgcatggaaataatactaaggtttggtgaagagcatgggtacagtagacagttgcacattaactttatgaataatgggaaagccacccctctccacctggctgtgcaaaatggtgacttggaaatgatcaaaatgtgcctggacaatggtgcacaaatagacccagtggagaagggaaggtgcacagccattcattttgctgccacccagggagccactgagattgttaaactgatgatatcgtcctattctggtagcgtggatattgttaacacaaccgatggatgtcatgagaccatgcttcacagagcttcattgtttgatcaccatgagctagcagactatttaatttcagtgggagcagatattaataagatcgattctgaaggacgctctccacttatattagcaactgcttctgcatcttggaatattgtaaatttgctactctctaaaggtgcccaagtagacataaaagataattttggacgtaattttctgcatttaactgtacagcaaccttatggattaaaaaatctgcgacctgaatttatgcagatgcaacagatcaaagagctggtaatggatgaagacaacgatgggtgtactcctctacattatgcatgtagacaggggggccctggttctgtaaataacctacttggctttaatgtgtccattcattccaaaagcaaagataagaaatcacctctgcattttgcagccagttatgggcgtatcaatacctgtcagaggctcctacaagacataagtgatacgaggcttctgaatgaaggtgaccttcatggaatgactcctctccatctggcagcaaagaatggacatgataaagtagttcagcttcttctgaaaaaaggtgcattgtttctcagtgaccacaatggctggacagctttgcatcatgcgtccatgggcgggtacactcagaccatgaaggtcattcttgatactaatttgaagtgcacagatcgcctggatgaagacgggaacactgcacttcactttgctgcaagggaaggccacgccaaagccgttgcgcttcttctgagccacaatgctgacatagtcctgaacaagcagcaggcctcctttttgcaccttgcacttcacaataagaggaaggaggttgttcttacgatcatcaggagcaaaagatgggatgaatgtcttaagattttcagtcataattctccaggcaataaatgtccaattacagaaatgatagaatacctccctgaatgcatgaaggtacttttagatttctgcatgttgcattccacagaagacaagtcctgccgagactattatatcgagtataatttcaaatatcttcaatgtccattagaattcaccaaaaaaacacctacacaggatgttatatatgaaccgcttacagccctcaacgcaatggtacaaaataaccgcatagagcttctcaatcatcctgtgtgtaaagaatatttactcatgaaatggttggcttatggatttagagctcatatgatgaatttaggatcttactgtcttggtctcatacctatgaccattctcgttgtcaatataaaaccaggaatggctttcaactcaactggcatcatcaatgaaactagtgatcattcagaaatactagataccacgaattcatatctaataaaaacttgtatgattttagtgtttttatcaagtatatttgggtattgcaaagaagcggggcaaattttccaacagaaaaggaattattttatggatataagcaatgttcttgaatggattatctacacgacgggcatcatttttgtgctgcccttgtttgttgaaataccagctcatctgcagtggcaatgtggagcaattgctgtttacttctattggatgaatttcttattgtatcttcaaagatttgaaaattgtggaatttttattgttatgttggaggtaattttgaaaactttgttgaggtctacagttgtatttatcttccttcttctggcttttggactcagcttttacatcctcctgaatttacaggatcccttcagctctccattgctttctataatccagaccttcagcatgatgctaggagatatcaattatcgagagtccttcctagaaccatatctgagaaatgaattggcacatccagttctgtcctttgcacaacttgtttccttcacaatatttgtcccaattgtcctcatgaatttacttattggtttggcagttggcgacattgctgaggtccagaaacatgcatcattgaagaggatagctatgcaggtggaacttcataccagcttagagaagaagctgccactttggtttctacgcaaagtggatcagaaatccaccatcgtgtatcccaacaaacccagatctggtgggatgttattccatatattctgttttttattttgcactggggaaataagacaagaaataccaaatgctgataaatctttagaaatggaaatattaaagcagaaataccggctgaaggatcttacttttctcctggaaaaacagcatgagctcattaaactgatcattcagaagatggagatcatctctgagacagaggatgatgatagccattgttcttttcaagacaggtttaagaaagagcagatggaacaaaggaatagcagatggaatactgtgttgagagcagtcaaggcaaaaacacaccatcttgagccttagctcctcagaccttcagtgaggcttctaatggggggtgcatgacttgctggttctaactttcaatttaaaaagagtgaggaagaagcagaatgattcattttgctgcgtgtgaaatcatggttcctgcatgctgtataaaagtaaaccatcttttatcctctattcatattttctaccaatcactatgtattggggatatctttgcagatatgttcaaattggactggactttgatgagatataatctcattatttgaatgggtagaaaatgaatttgctagaacacacatttttaatgaaaagaagtaataaatgtaactattaagctaaaatgcaaatgtcagtactgaattcctgcttgttaattacataatatgtgatgctctagaaaatagtcacaagtattaataatgccttagatgatagtcttaaatattaggttgaggtctacctaacctaagctgcttcctggaaagcttcatgttgaaagaacctatgggtggcaccatgtggacttttctgtccctactgtgatgaatagccccacccttcttgctgtccccaacacacctgatgtcactttgagccatatagttgaagtacaaattaataggccttatgatatgcacgaattttactatagataatatatgttgtttctggttttgtttgccaatgagcataataaatgtaaaacctatatagtatccctgtgattattgtatgagcctttgtttgagatttgaaaacaacatggctccatcacatattcccttttttcttttgatgtctactcaaatcatgaattaatcacatacctcatcattaatcttttcaaggtccttctattgttttgtctgattttctccatcatcctgattagcatgtttattccctcactacccccaggagatattcactgtaatgaatatgtctttggctatgtatgtgtccttgtgttatgttgtacagtgttgttttgagtctgttattatttacacagatgttattatgctatagcttctatttctgtttttgcttcttatttctcttataattctcacttatttcctattttttctactcatttctatttgttactcctttttactggacatgatgtttacaagatacaactgtgttactgtattccatctagtacggggcctttggtgtggcttactatttcattgtgtgcacccacccacccaccacactggacttttctagagatggacagcttggttacctccaccttcctgcactcattctcaaacatactgatgttcatacaaaccagcagagtgctgagggacgatatgtactattacaaaaccagacacttttacattcatggtccaacagatcacatggcctagaggcaatgttgcatataccttaatctttgatatgaataatatctttgttctttatatttcttaaaacagaaagggtggaaaatcactatacagaagcaatatccaaagatctcctgatcataaagacaaggggtcttttcagtcttccctctcctcaaaccttgtgtagcattgcacaatatagatctcagtcaacattcactgagtgccaagaatgtgagaaacactgtaccatgcctgtcatgcgaaatatttaaataaacagattgtcttaca

SEQ ID NO: 32136 - DNA, 4324 bp, Homo sapiens
atctctcgtcctcttcctgggctaggccgccccaggcgcggcccctgcgactcctggcacggccccgtgctcggctgccgccctggcgcgcgccacactgtcgtccccggacgggcgcggaccggctcggccggggcgccggcggctggggaggggtcgctggccccggggccgcgcatgcgccgccaccaacttggggctgtcagtggagggcgagtgctggttctcaggggaggcgacgcccttcggggccaacgggcctcgagccgaggcagcagtgggaacgactcatcctttttccagccctggggcgtggctggggtcggggtcggggtcggggccggtgggggccccgcccccgtctcctggcctgcccccttcatgggccgcgatgatggcggccctgtacccgagcacggacctctcgggcgcctcctcctcctccctgccttcctctccatcctcttcctcgccgaacgaggtgatggcgctgaaggatgtgcgggaggtgaaggaggagaatacgctgaatgagaagcttttcttgctggcgtgcgacaagggtgactattatatggttaaaaagattttggaggaaaacagttcaggtgacttgaacataaattgcgtagatgtgcttgggagaaatgctgttaccataactattgaaaacgaaaacttggatatactgcagcttcttttggactacggttgtcagaaactaatggaacgaattcagaatcctgagtattcaacaactatggatgttgcacctgtcattttagctgctcatcgtaacaactatgaaattcttacaatgctcttaaaacaggatgtatctctacccaagccccatgcagttggctgtgaatgcacattgtgttctgcaaaaaacaaaaaggatagcctccggcattccaggtttcgtcttgatatatatcgatgtttggccagtccagctctaataatgttaacagaggaggatccaattctgagagcatttgaacttagtgctgatttaaaagaactaagtcttgtggaggtggaattcaggaatgattatgaggaactagcccggcaatgtaaaatgtttgctaaggatttacttgcacaagcccggaattctcgtgaattggaagttattctaaaccatacgtctagtgacgagcctcttgacaaacggggattattagaagaaagaatgaatttaagtcgtctaaaacttgctatcaaatataaccagaaagagtttgtctcccagtctaactgccagcagttcctgaacactgtttggtttggacagatgtcgggttaccgacgcaagcccacctgtaagaagataatgactgttttgacagtaggcatcttttggccagttttgtcactttgttatttgatagctcccaaatctcagtttggcagaatcattcacacaccttttatgaaatttatcattcatggagcatcatatttcacatttctgctgttgcttaatctatactctcttgtctacaatgaggataagaaaaacacaatggggccagcccttgaaagaatagactatcttcttattctgtggattattgggatgatttggtcagacattaaaagactctggtatgaagggttggaagactttttagaagaatctcgtaatcaactcagttttgtcatgaattctctttatttggcaacctttgccctcaaagtggttgctcacaacaagtttcatgattttgctgatcggaaggattgggatgcattccatcctacactggtggcagaagggctttttgcatttgcaaatgttctaagttatcttcgtctcttttttatgtatacaaccagctctatcttgggtccattacagatttcaatgggacagatgttacaagattttggaaaatttcttgggatgtttcttcttgttttgttttctttcacaattggactgacacaactgtatgataaaggatatacttcaaaggagcagaaggactgtgtaggcatcttctgtgaacagcaaagcaatgataccttccattcgttcattggcacctgctttgctttgttctggtatattttctccttagcgcatgtggcaatctttgtcacaagatttagctatggagaagaactgcagtcctttgtgggagctgtcattgttggtacatacaatgtcgtggttgtgattgtgcttaccaaactgctggtggcaatgcttcataaaagctttcagttgatagcaaatcatgaagacaaagaatggaagtttgctcgagcaaaattatggcttagctactttgatgacaaatgtacgttacctccacctttcaacatcattccctcaccaaagactatctgctatatgattagtagcctcagtaagtggatttgctctcatacatcaaaaggcaaggtcaaacggcaaaacagtttaaaggaatggaggaatttgaaacagaagagagatgaaaactatcaaaaagtgatgtgctgcctagtgcatcgttacttgacttccatgagacagaagatgcaaagtacagatcaggcaactgtggaaaatctaaacgaactgcgccaagatctgtcaaaattccgaaatgaaataagggatttacttggctttcggacttctaaatatgctatgttttatccaagaaattaaccattttctaaatcatggagcgaataattttcaataacagatccaaaagactatattgcataacttgcaatgaaattaatgagatatatattgaaataaagaattatgtaaaagccattctttaaaatatttatagcataaatatatgttatgtaaagtgtgtatatagaattagttttttaaaccttctgttagtggctttttgcagaagcaaaacagattaagtagatagattttgttagcatgctgcttggttttcttacttagtgctttaaaatgtttttttttatgtttaagaggggcagttataaatggacacattgcccagaatgttttgtaaaatgaagaccagcaaatgtaggctgatctccttcacaggatacacttgaaatatagaagttatgttttaaatatctctgttttaggagttcacatatagttcagcatttattgtttaggagtataattttattttatctaaaataatagtctattttttcttttgtattttgttataatcttaagcaacaaagaaaaaaccctaatatttgaatctatttatgtctttcaatttaaattcacttcagtttttgttattgtaatatatttacttttacatggttataatcactttatatttttaatgtttttttcacttaatattttatatatacatttccatgtattgatgtagttagtccacatttaaatttttatagaattatatagtttttgaaaaatacagtcagtagatgttttattttttagctattcagttatgtttataagtttgcatagctacttctcgacatttggtttgttttaatttttttgtatcataatagtcctatttttttttcaagttggagtgaatgtttttagttttaagatagataggagacacttttttatcacatgtagtcacaacctgttttgtttttgtaaaacataggaagtctctttaatgcaatgatttgttttatatttggactaaggttcttgagcttatctcccaaggtactttccataatttaacacagcttctataaaagtgacttcatgcttacttgtggatcattcttgctgcttaagatgaaaagcattggttttttaaaattagagaataaaatatgtatttaaatttttggtgtgttcacataaagggatgtagctaaaatgttttcataggctattatatattctcgcagcatttccagttaagaggatattaggtatataattctcttcttaaccgaatgtcagatggtcttacgccacagggtgcaggtaacccttggtctgtaagcaccaccgatccagggatcattgtctaaataggttactattgtttgtttcatcttgcttttgcatttttattttttaatttccaaattttaagtgttccctctttggggcaaattcttataaaaatgtttattgtaaagttatatattttgtctacgatgggattatgcacttcccaattgggattttacatctggatttttagtcattctaaaaaacacctaattattaaaacatttatagagtgcctactgtatgcatgagttgagttgcttctgaggtacattttgaatgacagcatattgtaagaaaaaaaaaggtgaataaaatttgacattagattataaa

SEQ ID NO: 32137 - DNA, 2136 bp, Homo sapiens
atgatggcggccctgtacccgagcacggacctctcgggcgcctcctcctcctccctgccttcctctccatcctcttcctcgccgaacgaggtgatggcgctgaaggatgtgcgggaggtgaaggaggagaatacgctgaatgagaagcttttcttgctggcgtgcgacaagggtgactattatatggttaaaaagattttggaggaaaacagttcaggtgacttgaacataaattgcgtagatgtgcttgggagaaatgctgttaccataactattgaaaacgaaaacttggatatactgcagcttcttttggactacggttgtcagaaactaatggaacgaattcagaatcctgagtattcaacaactatggatgttgcacctgtcattttagctgctcatcgtaacaactatgaaattcttacaatgctcttaaaacaggatgtatctctacccaagccccatgcagttggctgtgaatgcacattgtgttctgcaaaaaacaaaaaggatagcctccggcattccaggtttcgtcttgatatatatcgatgtttggccagtccagctctaataatgttaacagaggaggatccaattctgagagcatttgaacttagtgctgatttaaaagaactaagtcttgtggaggtggaattcaggaatgattatgaggaactagcccggcaatgtaaaatgtttgctaaggatttacttgcacaagcccggaattctcgtgaattggaagttattctaaaccatacgtctagtgacgagcctcttgacaaacggggattattagaagaaagaatgaatttaagtcgtctaaaacttgctatcaaatataaccagaaagagtttgtctcccagtctaactgccagcagttcctgaacactgtttggtttggacagatgtcgggttaccgacgcaagcccacctgtaagaagataatgactgttttgacagtaggcatcttttggccagttttgtcactttgttatttgatagctcccaaatctcagtttggcagaatcattcacacaccttttatgaaatttatcattcatggagcatcatatttcacatttctgctgttgcttaatctatactctcttgtctacaatgaggataagaaaaacacaatggggccagcccttgaaagaatagactatcttcttattctgtggattattgggatgatttggtcagacattaaaagactctggtatgaagggttggaagactttttagaagaatctcgtaatcaactcagttttgtcatgaattctctttatttggcaacctttgccctcaaagtggttgctcacaacaagatttcaatgggacagatgttacaagattttggaaaatttcttgggatgtttcttcttgttttgttttctttcacaattggactgacacaactgtatgataaaggatatacttcaaaggagcagaaggactgtgtaggcatcttctgtgaacagcaaagcaatgataccttccattcgttcattggcacctgctttgctttgttctggtatattttctccttagcgcatgtggcaatctttgtcacaagatttagctatggagaagaactgcagtcctttgtgggagctgtcattgttggtacatacaatgtcgtggttgtgattgtgcttaccaaactgctggtggcaatgcttcataaaagctttcagttgatagcaaatcatgaagacaaagaatggaagtttgctcgagcaaaattatggcttagctactttgatgacaaatgtacgttacctccacctttcaacatcattccctcaccaaagactatctgctatatgattagtagcctcagtaagtggatttgctctcatacatcaaaaggcaaggtcaaacggcaaaacagtttaaaggaatggaggaatttgaaacagaagagagatgaaaactatcaaaaagtgatgtgctgcctagtgcatcgttacttgacttccatgagacagaagatgcaaagtacagatcaggcaactgtggaaaatctaaacgaactgcgccaagatctgtcaaaattccgaaatgaaataagggatttacttggctttcggacttctaaatatgctatgttttatccaagaaattaa

SEQ ID NO: 32138 - DNA, 3061 bp, Homo sapiens
gcgaacatctcctcggagcgcagctgggccagcggttcccacagccctggagcccaacgtgcgcagaagcgcctcttggagctcctctcccacagatctctcgtcctcttcctgggctaggccgccccaggcgcggcccctgcgactcctggcacggccccgtgctcggctgccgccctggcgcgcgccacactgtcgtccccggacgggcgcggaccggctcggccggggcgccggcggctggggaggggtcgctggccccggggccgcgcatgcgccgccaccaacttggggctgtcagtggagggcgagtgctggttctcaggggaggcgacgcccttcggggccaacgggcctcgagccgaggcagcagtgggaacgactcatcctttttccagccctggggcgtggctggggtcggggtcggggtcggggccggtgggggccccgcccccgtctcctggcctgcccccttcatgggccgcgatgatggcggccctgtacccgagcacggacctctcgggcgcctcctcctcctccctgccttcctctccatcctcttcctcgccgaacgaggtgatggcgctgaaggatgtgcgggaggtgaaggaggagaatacgctgaatgagaagcttttcttgctggcgtgcgacaagggtgactattatatggttaaaaagattttggaggaaaacagttcaggtgacttgaacataaattgcgtagatgtgcttgggagaaatgctgttaccataactattgaaaacgaaaacttggatatactgcagcttcttttggactacggttgtcagtctgcagatgcacttttggtggcaatcgactctgaagtagtgggagctgttgatatactacttaatcatcgaccaaaacgatcatcaagaccaactatagtaaaactaatggaacgaattcagaatcctgagtattcaacaactatggatgttgcacctgtcattttagctgctcatcgtaacaactatgaaattcttacaatgctcttaaaacaggatgtatctctacccaagccccatgcagttggctgtgaatgcacattgtgttctgcaaaaaacaaaaaggatagcctccggcattccaggtttcgtcttgatatatatcgatgtttggccagtccagctctaataatgttaacagaggaggatccaattctgagagcatttgaacttagtgctgatttaaaagaactaagtcttgtggaggtggaattcaggaatgattatgaggaactagcccggcaatgtaaaatgtttgctaaggatttacttgcacaagcccggaattctcgtgaattggaagttattctaaaccatacgtctagtgacgagcctcttgacaaacggggattattagaagaaagaatgaatttaagtcgtctaaaacttgctatcaaatataaccagaaagagtttgtctcccagtctaactgccagcagttcctgaacactgtttggtttggacagatgtcgggttaccgacgcaagcccacctgtaagaagataatgactgttttgacagtaggcatcttttggccagttttgtcactttgttatttgatagctcccaaatctcagtttggcagaatcattcacacaccttttatgaaatttatcattcatggagcatcatatttcacatttctgctgttgcttaatctatactctcttgtctacaatgaggataagaaaaacacaatggggccagcccttgaaagaatagactatcttcttattctgtggattattgggatgatttggtcagacattaaaagactctggtatgaagggttggaagactttttagaagaatctcgtaatcaactcagttttgtcatgaattctctttatttggcaacctttgccctcaaagtggttgctcacaacaagtttcatgattttgctgatcggaaggattgggatgcattccatcctacactggtggcagaagggctttttgcatttgcaaatgttctaagttatcttcgtctcttttttatgtatacaaccagctctatcttgggtccattacagatttcaatgggacagatgttacaagattttggaaaatttcttgggatgtttcttcttgttttgttttctttcacaattggactgacacaactgtatgataaaggatatacttcaaaggagcagaaggactgtgtaggcatcttctgtgaacagcaaagcaatgataccttccattcgttcattggcacctgctttgctttgttctggtatattttctccttagcgcatgtggcaatctttgtcacaagatttagctatggagaagaactgcagtcctttgtgggagctgtcattgttggtacatacaatgtcgtggttgtgattgtgcttaccaaactgctggtggcaatgcttcataaaagctttcagttgatagcaaatcatgaagacaaagaatggaagtttgctcgagcaaaattatggcttagctactttgatgacaaatgtacgttacctccacctttcaacatcattccctcaccaaagactatctgctatatgattagtagcctcagtaagtggatttgctctcatacatcaaaaggcaaggtcaaacggcaaaacagtttaaaggaatggaggaatttgaaacagaagagagatgaaaactatcaaaaagtgatgtgctgcctagtgcatcgttacttgacttccatgagacagaagatgcaaagtacagatcaggcaactgtggaaaatctaaacgaactgcgccaagatctgtcaaaattccgaaatgaaataagggatttacttggctttcggacttctaaatatgctatgttttatccaagaaattaaccattttctaaatcatggagcgaataattttcaataacagatccaaaagactatattgcataacttgcaatgaaattaatgagatatatattgaaataaagaattatgtaaaagccattctttaaaatatttatagcataaatatatgttatgtaaagtgtgtatatagaattagttttttaaaccttctgtt

SEQ ID NO: 32139 - DNA, 2912 bp, Homo sapiens
cttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaggctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaatagggaggcgagctgctgataacttgagaagacatcaccaataccaagaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaaggtaatagcaaggacaagaaaaagaatttcagcctttttgatttaaccaccctgattcatccgagatcagcagcaattgcctctgaaagacataacataagcaatggctctgccctggtggttcaggagccgcccagggagaagcagagaaaagtgaattttgtgaccgatatcaaaaactttgggttatttcatagacgatcaaaacaaaatgctgctgagcaaaatgcaaaccaaatcttctctgtttcagaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcgtttaccatacacatacgtattttccgtagtgctctgggtgggggaaaatgtttaaattgtattagcaaatgctaacttacactttatagcgtttatcagctgtggcatattacctgtaacatgtttaaataaggcaaaggcaatcaaaaacctttttgttttgtagcctgcttttgctttcacaatttgtcttacaattgtttttgttaataaataaatgcaccttgtattcttgtactgttgc

SEQ ID NO: 32140 - DNA, 2784 bp, Homo sapiens
cttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaggctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaatagggaggcgagctgctgataacttgagaagacatcaccaataccaagaagttatgaggaacctggtgaagcgatacgttgctgcaatgattagagatgctaaaactgaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcgtttaccatacacatacgtat

SEQ ID NO: 32141 - DNA, 2955 bp, Homo sapiens
cttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaggctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaatagggaggcgagctgctgataacttgagaagacatcaccaataccaagaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaagaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcgtttaccatacacatacgtat

SEQ ID NO: 32142 - DNA, 2760 bp, Homo sapiens
cttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaggctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctaggcgagctgctgataacttgagaagacatcaccaataccaagaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaagaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcgtttaccatacacatacgtat

SEQ ID NO: 32143 - DNA, 2475 bp, Homo sapiens
atggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaggctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaatagggaggcgagctgctgataacttgagaagacatcaccaataccaagaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaaggtaatagcaaggacaagaaaaagaatttcagcctttttgatttaaccaccctgattcatccgagatcagcagcaattgcctctgaaagacataacataagcaatggctctgccctggtggttcaggagccgcccagggagaagcagagaaaagtgaattttgtgaccgatatcaaaaactttgggttatttcatagacgatcaaaacaaaatgctgctgagcaaaatgcaaaccaaatcttctctgtttcagaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcgtttaccatacacatacgtattttccgtagtgctctgggtggg

SEQ ID NO: 32144 - DNA, 3446 bp, Homo sapiens
cttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaggctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaataggggtaagaacacagcataggcgagctgctgataacttgagaagacatcaccaataccaagaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaaggtaatagcaaggacaagaaaaagaatttcagcctttttgatttaaccaccctgattcatccgagatcagcagcaattgcctctgaaagacataacataagcaatggctctgccctggtggttcaggagccgcccagggagaagcagagaaaagtgaattttgtgaccgatatcaaaaactttgggttatttcatagacgatcaaaacaaaatgctgctgagcaaaatgcaaaccaaatcttctctgtttcagaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcgtttaccatacacatacgtattttccgtagtgctctgggtgggggaaaatgtttaaattgtattagcaaatgctaacttacactttatagcgtttatcagctgtggcatattacctgtaacatgtttaaataaggcaaaggcaatcaaaaacctttttgttttgtagcctgcttttgctttcacaatttgtcttacaattgtttttgttaataaataaatgcaccttgtattcttgtactgttgc

SEQ ID NO: 32145 - DNA, 4059 bp, Homo sapiens
agtcgcccagagaagcgggagtgggagaagctttgagagttgcaggggactacttttttccggtcgggcggcgggcctcatgggtgcttgtttaccgggctgggagcagggcattcaaaagctgggtgtcggagcgcactgaagtccaacacgcctgcagagaccgccctaagcctggaggtgtgtctggcttgcatccagaaccacagggtggattctcgccaccgacttggctggatgacggctggctggtggtgagctcccctgcccactggctgacctcaagcagttggccccggtaggtggaggctattcgagggggacaagctggggacgcagcgtcagctcctgccagcgcgcgggtctcctccacctccaagcagtgtggtgcgtgggacgcgcatcttcccggactatccctttccagcgcggtctgtgcggaccccgagcccggcagccaccagggacggagggcggggtgcctttctctgggctcatccgctgtcagccgtgggaactcttaactttatccagagggatctgtgcaggcgggggtgggagaggttctcctcccctggcggttacctccccctcccgggccgcccctcccccgcctcccatggcttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaggctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaatagggaggcgagctgctgataacttgagaagacatcaccaataccaagaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaaggtaatagcaaggacaagaaaaagaatttcagcctttttgatttaaccaccctgattcatccgagatcagcagcaattgcctctgaaagacataacataagcaatggctctgccctggtggttcaggagccgcccagggagaagcagagaaaagtgaattttgtgaccgatatcaaaaactttgggttatttcatagacgatcaaaacaaaatgctgctgagcaaaatgcaaaccaaatcttctctgtttcagaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcgtttaccatacacatacgtattttccgtagtgctctgggtgggggaaaatgtttaaattgtattagcaaatgctaacttacactttatagcgtttatcagctgtggcatattacctgtaacatgtttaaataaggcaaaggcaatcaaaaacctttttgttttgtagcctgcttttgctttcacaatttgtcttacaattgtttttgttaataaataaatgcaccttgtattcttgtactgttgcaataa

SEQ ID NO: 32146 - DNA, 2709 bp, Homo sapiens
tgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaaggttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaatagggaggcgagctgctgataacttgagaagacatcaccaataccaagtaagttgtccttgtactatgtcttgaaattttcactaaaataaaatgcagtccccccttcagaactgactcaggaggaaatttatttactcattgagtatcaatactcttgttctaaaatgcctcaggaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcgtttaccatacacatacgtattttccgtagtgctctgggtggg

SEQ ID NO: 32147 - DNA, 3369 bp, Homo sapiens
agtcgcccagagaagcgggagtgggagaagctttgagagttgcaggggactacttttttccggtcgggcggcgggcctcatgggtgcttgtttaccgggctgggagcagggcattcaaaagctgggtgtcggagcgcactgaagtccaacacgcctgcagagaccgccctaagcctggaggtgtgtctggcttgcatccagaaccacagggtggattctcgccaccgacttggctggatgacggctggctggtggtgagctcccctgcccactggctgacctcaagcagttggccccggtaggtggaggctattcgagggggacaagctggggacgcagcgtcagctcctgccagcgcgcgggtctcctccacctccaagcagtgtggtgcgtgggacgcgcatcttcccggactatccctttccagcgcggtctgtgcggaccccgagcccggcagccaccagggacggagggcggggtgcctttctctgggctcatccgctgtcagccgtgggaactcttaactttatccagagggatctgtgcaggcgggggtgggagaggttctcctcccctggcggttacctccccctcccgggccgcccctcccccgcctcccatggcttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaggctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaatagggaggcgagctgctgataacttgagaagacatcaccaataccaagaagttatgaggaacctggtgaagcgatacgttgctgcaatgattagagatgctaaaactgaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtga

SEQ ID NO: 32148 - DNA, 3226 bp, Homo sapiens
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttacatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggccgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 32149 - DNA, 2489 bp, Homo sapiens
gcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaagcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcat

SEQ ID NO: 32150 - DNA, 3138 bp, Homo sapiens
ggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttacatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggccgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttatttt

SEQ ID NO: 32151 - DNA, 1746 bp, Homo sapiens
cctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctgg

SEQ ID NO: 32152 - DNA, 2504 bp, Homo sapiens
gcttcctgtttgtccgacgaggagacatggcggcggcgccggtagcggctgggtctggagccggccgagggagacggtcggcagccacagtggcggcttggggcggatggggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttacatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttg

SEQ ID NO: 32153 - DNA, 5839 bp, Homo sapiens
accccacatcacaaccacgacgggttgtccgcagctcgcagccaccccaaagggaggaataaagaacaggagcagagggaagccgggcgcagaaagaagggaaaaggaagagctcagggttggacatttttggagacaggggtggggaggataaagggagcgtgcctccttgattttcccctccccacccctctttgcttttctctccccttctctgtatagcatattccagaaacggcagcagaaggggacagaaacctctagtgtagaaaagggttttggaggggtagccagcgctcccgccagccgctacctaacagctggagcttgagtgtgcgtgtaagagtgtgaatgcggctctctctctttttttctctctctctcccctctctctccatcccttccttcctccctccttctccctctccttcacactacagtgtcagctacccctgtcagtttccccgtgtcagtttcttccctagctcttattgtgtgtgactggctgcgtgaagggagtgggtgcgcttgaaggggctcaggttgggttagagagctgggagaacagggtagggacattggtagagcaaagagtttcagggcactggcgaaggtgaaaggtgaggagggccgatctgttacaggcaagtttggcaataactgagcatccaaaggggaagccaaggtaggagccagtacttgcgctcgtctttacaccccgcccctttccctgtgctcatccgcccacccacccatcagcctagaggccccgggctgtcccagtcggctgctgtttcgcgccgcaaaagaggagtccggcaaggcgccgcaccacgcatcctggccggtggacatccagacgacacagattttatccgaaaaaaccacttggctcaggatttctgcattgctatgaaccatggcccaactgtactacaaaaaggtcaactactcaccgtacagagaccgcatccccctgcaaattgtgagggctgagacagagctctctgcagaggagaaggccttcctcaatgctgtggagaagggggactatgccactgtgaagcaggcccttcaggaggctgagatctactataatgttaacatcaactgcatggaccccttgggccggagtgccctgctcattgccattgagaacgagaacctggagatcatggagctactgctgaaccacagcgtgtatgtgggtgatgcattgctctatgccatacgcaaggaagtggtgggcgctgtggagcttctgctcagctacaggcggcccagcggagagaagcaggtccccactctgatgatggacacgcagttctctgaattcacaccggacatcactcccatcatgctggctgcccacaccaacaactacgaaatcatcaaattgcttgtccaaaaacgggtcactatcccacggccccaccagatccgctgcaactgtgtggagtgtgtgtctagttcagaggtagacagcctgcgccactctcgctcccgactgaacatctataaggctctggcaagcccctcactcattgccttatcaagtgaggaccccatcctaactgccttccgtctgggctgggagctcaaggagctcagcaaggtggagaatgagttcaaggccgagtatgaggagctctctcagcagtgcaagctctttgccaaagacctgctggaccaagctcggagctccagggaactggagatcatcctcaaccatcgagatgaccacagtgaagagcttgaccctcagaagtaccatgacctggccaagttgaaggtggcaatcaaataccaccagaaagagtttgttgctcagcccaactgccaacagttgcttgccaccctgtggtatgatggcttccctggatggcggcggaaacactgggtagtcaagcttctaacctgcatgaccattgggttcctgtttcccatgctgtctatagcctacctgatctcacccaggagcaaccttgggctgttcatcaagaaaccctttatcaagtttatctgccacacagcatcctatttgaccttcctctttatgcttctcctggcttctcagcacattgtcaggacagaccttcatgtacaggggcctcccccaactgtcgtggaatggatgatattgccttgggttctaggtttcatttggggtgagattaaggaaatgtgggatggtggatttactgaatacatccatgactggtggaacctgatggattttgcaatgaactccctctacctggcaactatttccctgaagattgtggcctatgtcaagtataatggttctcgtccaagggaggaatgggaaatgtggcacccgactctgattgcggaagcactcttcgcaatatccaacattttaagttcgttgcgtctcatatccctgttcacagccaactcccacttaggacctctgcagatctctttgggacgcatgctgcttgatatcctcaaattcctctttatctactgcctggtactactagcttttgccaatggactgaaccagctttacttctattatgaaaccagagctatcgatgagcctaacaactgcaaggggatccgatgtgagaaacagaacaatgccttctccacgctctttgagactcttcagtcactcttctggtctgtatttggccttttaaatctatatgtcaccaatgtgaaagccagacacgaattcaccgagtttgtaggagctaccatgtttggaacatacaatgtcatctccctggtagtgctgctgaacatgctgattgctatgatgaacaactcctatcagcttattgccgatcatgctgatatcgagtggaagtttgcaaggacgaagctctggatgagttactttgatgaaggtggcaccttgccacctcctttcaacatcatccccagccccaagtcatttctataccttggtaactggttcaacaacaccttctgccccaaaagagaccctgacggtagacggagaaggcgcaacttgagaagtttcacagaacgcaatgctgacagcctgatacaaaatcaacattatcaggaagttatcaggaatttagtcaaaagatatgtggctgctatgataagaaattccaaaacacatgagggacttacagaagaaaattttaaggaattaaagcaagacatctccagctttcggtatgaagtgcttgacctcttgggaaatagaaaacatccaaggagcttttccactagcagcactgaactgtctcagagagacgataataatgatggcagtggtggggctcgggccaaatccaagagtgtctcttttaatttaggctgcaagaaaaagacttgccatgggccacctctcatcagaaccatgccaaggtccagtggtgcccaaggaaagtcaaaagctgagtcatcaagcaaacgctccttcatgggtccttctctcaagaaactgggtctcctattctccaaatttaatggtcatatgtctgaacccagttcagagccaatgtacacaatttctgatggaattgttcagcagcactgtatgtggcaggacatcagatattctcagatggagaaagggaaagcagaggcctgttctcaaagtgaaattaacctcagtgaggtagaattaggtgaagtccagggcgctgctcagagcagtgaatgccctctagcctgttccagctctcttcactgtgcatccagcatctgctcctcaaattctaaacttttagactcctcagaggatgtatttgaaacttggggagaggcttgtgacttgctcatgcacaaatggggtgatggacaggaagaacaagttacaactcgcctctaagtcaagccctaatcatctgttctggaactcaacagaaatctgtaatttccttgctctcagaggtgacacagaatatgattccctcactgcccctgccccccagaaaggagagtgaaactcttatttgcaccatcttttatagccacattctccatttttgttcttgttttattattactttcattattatttgcctttttaatacctatacacactaagtccatcttacaaccgactgaaggggtgttgcacctaatcatcagaggtgcagttgggtgcttaacctttttgctttgcttttctcacccatgcttccttgaagccccaggtgccactttgctggtcttgttgccgcacagattcctgaccatcctcagaatctcatgccattttcccgcagagctgagggatgtggtcagcagtccccaccagctatcagataaggcaaactaccctgcccatctttgttgccattcagtgctacgcgctgcccatgctgggtcaatgaacagcatcaaagggaggctgaagagatttcaaagaattgtcagcttgtggtttctgggtataagtggcttgtttcgttcttaaatactacaacttcttattgtgggggctattgagttttcttgtttcttaaagatgtgttagtttcctaatgtgtgccaatgaaatatttaccccatagtatatgtcatatctaataagttaggcgaattatttttctgtttgtgtgtttcagttaacttactacatttgaaaatttgatagtatcaaaattagtatttagaatttgtgctattttttaaaaacatctactacactctaaccaatagtcactacatctcatacattggcaagataaatagttgtcatatttgttgggtcctattctactgttgatagttttaattatcattgctatcaaataatttctaagataaaagcctgaatttgaaatatttttatcagaaaaatggcatattgctgaagtgtcaaaatatgagaaaagagcatcttcattttaattaactgctttataaaaatggcaactttaggtatagataacctaattcaggttgcagttttaatattcattgggggcagtggaattgcatgtgtaaattatgttagatatatatcataacaaccctagtggattcatggaattataaacgtgatccaaattctactgtcttccaagaaagctacatttatacatccaaacaaattcttttccacagcttaagagtacctcatcagaatacagtggttcaagttaaaaaataaagtccataatgcatatggtcatcattctagacctgataaccactgagaacctgctgagcaaggacggcttttaccaacattagcacaaaggtttcctcagtttagactctaacatatgacctgaaacaactctaggtctgagtcctagagattacataaatagtgtgtagcccagaaaagtaaaataggtgtcacgctgttttttttaatgtcaacaccaataggaatccatttagattaatgtatgtaatttctgataaaagtaagagaaatgaggaactttcgaactgcaaatatgcctccaaactagcttttgataagtgtggtttctgttatttgaatggattcccatctttgtctctagcctggagaagagcaaaatggagggggaggggccagaaataggaggaggttttgaagaataaagcctcatatccaggaaaaagtgatcaagtgaaaaagctgcatcaagacccatttggcaagaggttgtccgaaaataattccttgatcatatctgaagtggttatttactcaaatcaatttctcccctgcttcgctaagactgtcataaaatggccttgacatttaatcacaggttactttccagaaaggtttctaaagttacagattcagcttttcaaattgtcaaattcactttgaataataatagaacctgggctacattcctaactcatattaacagca

SEQ ID NO: 32154 - DNA, 4612 bp, Homo sapiens
gggatcttgacggagagtgcgggggatgaaggcgggagctgagggctggagagtctctgttgacatagtaactcttcagctccgtctcccttgctctccgctcttacgcttcgctaccaccagcggccccgcctgtgccctctctgcccgggcgccccagacgcatcctcgcggggtctcctcggcctgacctgctcaggtcaagatcctctttgcacccccttaagtggtgacttttccccgggccagtgggcgagccacttgcggcgggcgtctgcaccccctgcttcaccgtcgtcccctgggcaccggtctgcccaggtccagttcggccgctgacgcgaaccctccgcaccgggtccccgctggaactgcccactcggctcccccgggagcggggcccaggccagtcgggcgttcccgccatgagccagagcccggcgttcgggccccggaggggcagttctccccggggcgctgccggagccgctgcgcggcgcaacgagagccaggactatctgctcatggactcggagctgggagaagacggctgcccgcaagccccgctgccttgctacggctactacccctgcttccggggatctgacaacagactggctcaccggcggcagacagttctccgtgagaaggggagaaggttagctaatcgaggaccagcatacatgtttagtgatcgctccacaagcctatctatagaggaggaacgctttttggatgcagctgaatatggtaacatcccagtggtgcggaagatgttagaagaatgccactcactcaacgttaactgtgtggattacatgggccagaatgccctacagttggcagtggccaatgagcatctggaaattacagaacttcttctcaagaaagaaaacctctctcgagttggggatgctttgcttctagctattagtaaaggttatgttcggattgtggaagcaattctcagtcatccggcttttgctgaaggcaagaggttagcaaccagccctagccagtctgaactccagcaagatgatttttatgcctatgatgaagatgggacacggttctcccatgatgtgactccaatcattctggctgcccactgccaggaatatgaaattgtgcataccctcctgcggaagggtgctaggattgaacggcctcatgattatttctgcaagtgcaatgactgcaaccagaaacagaagcatgactcgtttagccactccagatctaggattaatgcctataaaggcctggcaagtccggcttacctgtcattgtctagtgaagatccagtcatgacggctttagaacttagcaatgaactggcagttctggccaatattgagaaagagttcaagaatgactacaaaaaactgtcaatgcagtgcaaagactttgttgttggactccttgatctgtgcagaaacactgaagaagtcgaggccattctgaatggggatgttgaaacgctccagagtggtgatcacggtcgcccaaatctcagccgtttaaaacttgccattaaatatgaagtaaaaaaatttgtagctcatccaaactgccaacagcaacttctctccatttggtatgagaatctttctggtttacgacagcagacaatggcggtcaagttccttgtggtccttgctgttgccattggactgcccttcctggctctcatttactggtttgctccatgcagcaagatggggaagataatgcgtggaccattcatgaagtttgtagcacacgcagcctccttcaccatttttctgggactgctagtcatgaatgcagctgacagatttgaaggcacaaaactccttcctaatgaaaccagcacagataatgcaaaacagctgttcaggatgaaaacatcctgcttctcatggatggagatgctcattatatcctgggtaataggcatgatatgggctgaatgtaaagaaatctggactcagggccccaaggaatatttgtttgagttgtggaacatgcttgattttggtatgttagcaattttcgcagcatcattcattgcgagattcatggcattttggcatgcttccaaagcccagagcatcattgacgcaaatgatactttgaaggacttgacgaaagtaacattgggagacaatgtgaaatactacaatttggccaggataaagtgggacccctctgatcctcaaataatatctgaaggtctttatgcaattgctgtagttttaagtttctctaggatagcttatattttaccagcaaatgaaagctttggacctctgcagatatcacttggaagaacagtcaaagacatcttcaagttcatggtcatattcattatggtgtttgtggcctttatgattggaatgttcaatctctactcctactacattggtgcaaaacaaaatgaagccttcacaacagttgaagagagttttaagacactgttctgggctatatttggactttctgaagtgaaatcagtggtcatcaactataaccacaaattcattgaaaacattggttacgttctttatggagtctataatgttacgatggtcattgttttgctaaatatgttaattgccatgatcaacagttcattccaggaaattgaggatgacgctgatgtggagtggaaatttgcaagggccaaactctggttttcctactttgaggagggcagaacacttcctgtacccttcaatctggtgccgagtccaaagtccctgttttatctcttactgaagcttaaaaaatggatttctgagctgttccagggccataaaaaaggtttccaggaagatgcagagatgaacaagataaatgaagaaaagaaacttggaattttaggaagtcatgaagacctttcaaaattatcacttgacaaaaaacaggttgggcacaataaacaaccaagtataaggagctcagaagatttccatctaaatagtttcaataatcctccaagacaatatcagaaaataatgaaaaggctcattaaaagatatgtactgcaggcccagatagataaggagagtgatgaagtgaacgaaggggaactgaaggaaattaagcaggacatctcaagtctccgctatgaactccttgaagaaaaatctcagaatacagaagacctagcagaacttattagagaacttggagagaaattatccatggaaccaaatcaagaggaaaccaatagataatgcgaagacttccttagaaattcatatttatttgtccacttgaagccatattattttctgatttattttcttaagtgccaatgggcccaccttttaaacaagaaaacgttaaataacttgggccatcctatcatctggagccctagtatctaatttttttggtgattaaactccattgttcagggtaaaggctgtagataatgaggaaaattatgcccagttgtttggtgcttgttttataaactgctttcttggatataactaactcttgtgatgatgtcattgccatgtagtgtctgcctgaaaatgggtcccagcggacaggggctgacccacgttactccccatgcggtttttcctctgaagtttatttcaggttccttcttgcctgctctgtggatcccctgctggggactcccagctctgaaatttgggaaaaagtagcccatgggcctttagaatgctttaatcctttctttagaatgctgtttaaacaccatttaccctacttatccctcaatgcacatgattgataccgttcatacaaaatggtcttacatctatgtaaaattttctgattcatctatttgaaaacattacacttaacaatgaaaaaagtttttcctccactgaaccctggaaacatggtccagttttgtgtgtgtgcgtgtgtgtaaatgtgtacacacagacataaagtacttgccctagtttgtggctaatgtggacacacaaaagctctttatgttataaatttttattgtcactaaaaaattttactgtctaaataagtaccttttattggagaaaaatcaaaaccccaaacaaacactgtggttgtttggttccattatagcacaattttgtgccatttctgggagcatttacagatgaatccccacacttagccattgaatgtaaaggggaaaaataaggtgagaatttgtaaatacttatctgttattttcaatatgttctatccttctacccaaatatataaaacaggaatttgcattcatgtgcatttaccaagaggttgttgttgttacttactgatcatgtgaagtggtgtcttaaacaactaaaagcgatgaaggttcatatgtttactcaaagaccattggcattcagaggatgctggacattaactggaactgctacttccaattcaataatgggagatttcaaatgcaaatctttaacttcatcttaaagatgaaatggttgcagaaaatctgtttagctccaactttggcttaatttaaatcaaagaacatttatgtaaccagatcagaaaatacagctgaaaatttatattcagtgattttgtatttgtggatactacttatggaaaagttacttggtgatacataaagatcgattttcaaata

SEQ ID NO: 32155 - DNA, 2448 bp, Homo sapiens
atgagccagagcccggcgttcgggccccggaggggcagttctccccggggcgctgccggagccgctgcgcggcgcaacgagagccaggactatctgctcatggactcggagctgggagaagacggctgcccgcaagccccgctgccttgctacggctactacccctgcttccggggatctgacaacagactggctcaccggcggcagacagttctccgtgagaaggggagaaggttagctaatcgaggaccagcatacatgtttagtgatcgctccacaagcctatctatagaggaggaacgctttttggatgcagctgaatatggtaacatcccagtggtgcggaagatgttagaagaatgccactcactcaacgttaactgtgtggattacatgggccagaatgccctacagttggcagtggccaatgagcatctggaaattacagaacttcttctcaagaaagaaaacctctctcgagttggggatgctttgcttctagctattagtaaaggttatgttcggattgtggaagcaattctcagtcatccggcttttgctgaaggcaagaggttagcaaccagccctagccagtctgaactccagcaagatgatttttatgcctatgatgaagatgggacacggttctcccatgatgtgactccaatcattctggctgcccactgccaggaatatgaaattgtgcataccctcctgcggaagggtgctaggattgaacggcctcatgattatttctgcaagtgcaatgactgcaaccagaaacagaagcatgactcgtttagccactccagatctaggattaatgcctataaaggcctggcaagtccggcttacctgtcattgtctagtgaagatccagtcatgacggctttagaacttagcaatgaactggcagttctggccaatattgagaaagagttcaagatggggaagataatgcgtggaccattcatgaagtttgtagcacacgcagcctccttcaccatttttctgggactgctagtcatgaatgcagctgacagatttgaaggcacaaaactccttcctaatgaaaccagcacagataatgcaaaacagctgttcaggatgaaaacatcctgcttctcatggatggagatgctcattatatcctgggtaataggcatgatatgggctgaatgtaaagaaatctggactcagggccccaaggaatatttgtttgagttgtggaacatgcttgattttggtatgttagcaattttcgcagcatcattcattgcgagattcatggcattttggcatgcttccaaagcccagagcatcattgacgcaaatgatactttgaaggacttgacgaaagtaacattgggagacaatgtgaaatactacaatttggccaggataaagtgggacccctctgatcctcaaataatatctgaaggtctttatgcaattgctgtagttttaagtttctctaggatagcttatattttaccagcaaatgaaagctttggacctctgcagatatcacttggaagaacagtcaaagacatcttcaagttcatggtcatattcattatggtgtttgtggcctttatgattggaatgttcaatctctactcctactacattggtgcaaaacaaaatgaagccttcacaacagttgaagagagttttaagacactgttctgggctatatttggactttctgaagtgaaatcagtggtcatcaactataaccacaaattcattgaaaacattggttacgttctttatggagtctataatgttacgatggtcattgttttgctaaatatgttaattgccatgatcaacagttcattccaggaaattgaggatgacgctgatgtggagtggaaatttgcaagggccaaactctggttttcctactttgaggagggcagaacacttcctgtacccttcaatctggtgccgagtccaaagtccctgttttatctcttactgaagcttaaaaaatggatttctgagctgttccagggccataaaaaaggtttccaggaagatgcagagatgaacaagataaatgaagaaaagaaacttggaattttaggaagtcatgaagacctttcaaaattatcacttgacaaaaaacaggttgggcacaataaacaaccaagtataaggagctcagaagatttccatctaaatagtttcaataatcctccaagacaatatcagaaaataatgaaaaggctcattaaaagatatgtactgcaggcccagatagataaggagagtgatgaagtgaacgaaggggaactgaaggaaattaagcaggacatctcaagtctccgctatgaactccttgaagaaaaatctcagaatacagaagacctagcagaacttattagagaacttggagagaaattatccatggaaccaaatcaagaggaaaccaatagataa

SEQ ID NO: 32156 - DNA, 2631 bp, Homo sapiens
atgagccagagcccggcgttcgggccccggaggggcagttctccccggggcgctgccggagccgctgcgcggcgcaacgagagccaggactatctgctcatggactcggagctgggagaagacggctgcccgcaagccccgctgccttgctacggctactacccctgcttccggggatctgacaacagactggctcaccggcggcagacagttctccgtgagaaggggagaaggttagctaatcgaggaccagcatacatgtttagtgatcgctccacaagcctatctatagaggaggaacgctttttggatgcagctgaatatggtaacatcccagtggtgcggaagatgttagaagaatgccactcactcaacgttaactgtgtggattacatgggccagaatgccctacagttggcagtggccaatgagcatctggaaattacagaacttcttctcaagaaagaaaacctctctcgagttggggatgctttgcttctagctattagtaaaggttatgttcggattgtggaagcaattctcagtcatccggcttttgctgaaggcaagaggttagcaaccagccctagccagtctgaactccagcaagatgatttttatgcctatgatgaagatgggacacggttctcccatgatgtgactccaatcattctggctgcccactgccaggaatatgaaattgtgcataccctcctgcggaagggtgctaggattgaacggcctcatgattatttctgcaagtgcaatgactgcaaccagaaacagaagcatgactcgtttagccactccagatctaggattaatgcctataaaggcctggcaagtccggcttacctgtcattgtctagtgaagatccagtcatgacggctttagaacttagcaatgaactggcagttctggccaatattgagaaagagttcaagaatgactacaaaaaactgtcaatgcagtgcaaagactttgttgttggactccttgatctgtgcagaaacactgaagaagtcgaggccattctgaatggggatgttgaaacgctccagagtggtgatcacggtcgcccaaatctcagccgtttaaaacttgccattaaatatgaagtaaaaaaaatggggaagataatgcgtggaccattcatgaagtttgtagcacacgcagcctccttcaccatttttctgggactgctagtcatgaatgcagctgacagatttgaaggcacaaaactccttcctaatgaaaccagcacagataatgcaaaacagctgttcaggatgaaaacatcctgcttctcatggatggagatgctcattatatcctgggtaataggcatgatatgggctgaatgtaaagaaatctggactcagggccccaaggaatatttgtttgagttgtggaacatgcttgattttggtatgttagcaattttcgcagcatcattcattgcgagattcatggcattttggcatgcttccaaagcccagagcatcattgacgcaaatgatactttgaaggacttgacgaaagtaacattgggagacaatgtgaaatactacaatttggccaggataaagtgggacccctctgatcctcaaataatatctgaaggtctttatgcaattgctgtagttttaagtttctctaggatagcttatattttaccagcaaatgaaagctttggacctctgcagatatcacttggaagaacagtcaaagacatcttcaagttcatggtcatattcattatggtgtttgtggcctttatgattggaatgttcaatctctactcctactacattggtgcaaaacaaaatgaagccttcacaacagttgaagagagttttaagacactgttctgggctatatttggactttctgaagtgaaatcagtggtcatcaactataaccacaaattcattgaaaacattggttacgttctttatggagtctataatgttacgatggtcattgttttgctaaatatgttaattgccatgatcaacagttcattccaggaaattgaggatgacgctgatgtggagtggaaatttgcaagggccaaactctggttttcctactttgaggagggcagaacacttcctgtacccttcaatctggtgccgagtccaaagtccctgttttatctcttactgaagcttaaaaaatggatttctgagctgttccagggccataaaaaaggtttccaggaagatgcagagatgaacaagataaatgaagaaaagaaacttggaattttaggaagtcatgaagacctttcaaaattatcacttgacaaaaaacaggttgggcacaataaacaaccaagtataaggagctcagaagatttccatctaaatagtttcaataatcctccaagacaatatcagaaaataatgaaaaggctcattaaaagatatgtactgcaggcccagatagataaggagagtgatgaagtgaacgaaggggaactgaaggaaattaagcaggacatctcaagtctccgctatgaactccttgaagaaaaatctcagaatacagaagacctagcagaacttattagagaacttggagagaaattatccatggaaccaaatcaagaggaaaccaatagataa

SEQ ID NO: 32157 - DNA, 2752 bp, Homo sapiens
cacggttctgcctcggaaggcgagtttttaccactgcaacacaaagaacagaggagcgcgctttcacatcgttgcaacttaactcacttgaccagctctatacttcagcaccacggagagcggtacatccttggctaccacccatggggagccagcttctggcgactcaacaccggattccggtcatctagaggaggaacaagcctgcgtattacaccctcaatgttgaggaacagcaccttcaaaaacatgcagcgccggcacacaacgctgagggagaagggccgtcgccaggccatccggggtcccgcctacatgttcaacgagaagggcaccagtctgacgcccgaggaggagcgcttcctggactcggctgagtatggcaacatcccggtggtccggaaaatgctggaggagtccaagacccttaacttcaactgtgtggactacatggggcagaacgctctgcagctggccgtgggcaacgagcacctagaggtcacggagctgctgctgaagaaggagaacctggcacgggtgggggacgcgctgctgctggccatcagcaagggctatgtgcgcatcgtggaggccatcctcaaccacccggccttcgcgcagggccagcgcctgacgctcagcccgctggaacaggagctgcgcgacgacgacttctatgcctacgacgaggacggcacgcgcttctcccacgacatcacgcccatcatcctggcggcgcactgccaggagtatgagatcgtgcacatcctgctgctcaagggcgcccgcatcgagcggccccacgactacttctgcaagtgcaatgagtgcaccgagaaacagcggaaagactccttcagccactcgcgctcgcgcatgaacgcctacaaaggactggcgagtgctgcctacttgtccctgtccagcgaagaccctgtcctcaccgccctggagctcagcaacgagttagccagactagccaacattgagactgaatttaagttcgttgctcatcctaactgtcagcagcaattgcttaccatgtggtatgaaaatctctcaggcttacgtcaacagtctatcgctgtgaaattcctggctgtctttggagtctccataggcctcccttttctcgccatagcctattggattgctccgtgcagcaagctaggacgaaccctgaggagccctttcatgaagtttgtagctcatgcagtttcttttacaatcttcttgggattattagttgtgaatgcatctgaccgatttgaaggtgttaaaaccctgccaaacgaaaccttcacagactacccaaaacaaatcttcagagtgaaaaccacacagttctcctggacagaaatgctcattatgaagtgggtcttaggaatgatttggtccgaatgcaaggaaatctgggaggaggggccacgggagtacgtgctgcacttgtggaacctgctagatttcgggatgctgtccatcttcgtggcctccttcacagcacgcttcatggccttcctgaaggccacggaggcacagctgtacgtggaccagcacgtgcaggacgacacgctgcacaatgtctcgcttccgccggaagtggcatacttcacctacgccagggacaagtggtggccttcagaccctcagatcatatcggaagggctctacgcgatagccgtcgtgctgagcttctctcgcattgcatacattctgccagccaacgagagttttgggcccctgcagatctcgctagggagaactgtgaaagatatcttcaagttcatggtcattttcatcatggtatttgtggccttcatgattgggatgttcaacctgtactcttactaccgaggtgccaaatacaacccagcgtttacaacggttgaagaaagttttaaaactttgttttggtccatattcggcttatctgaagtaatctcagtggtgctgaaatacgaccacaaattcatcgagaacattggctacgttctctacggcgtttataacgtcaccatggtggtagtgttgctcaacatgctaatagccatgataaacaactcctatcaggaaattgaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttagcagcccacatcggcgtctgtgacttctaccagcattccaaggccaggttggatgccctcgcccccatccttggtggggaggggtccccagcccactcctctaggacacgaaggggatctcctgg

SEQ ID NO: 32158 - DNA, 2587 bp, Homo sapiens
cacggttctgcctcggaaggcgagtttttaccactgcaacacaaagaacagaggagcgcgctttcacatcgttgcaacttaactcacttgaccagctctatacttcagcaccacggagagcggtacatccttggctaccacccatggggagccagcttctggcgactcaacaccggattccggtcatctagaggaggaacaagcctgcgtattacaccctcaatgttgaggaacagcaccttcaaaaacatgcagcgccggcacacaacgctgagggagaagggccgtcgccaggccatccggggtcccgcctacatgttcaacgagaagggcaccagtctgacgcccgaggaggagcgcttcctggactcggctgagtatggcaacatcccggtggtccggaaaatgctggaggagtccaagacccttaacttcaactgtgtggactacatggggcagaacgctctgcagctggccgtgggcaacgagcacctagaggtcacggagctgctgctgaagaaggagaacctggcacgggtgggggacgcgctgctgctggccatcagcaagggctatgtgcgcatcgtggaggccatcctcaaccacccggccttcgcgcagggccagcgcctgacgctcagcccgctggaacaggagctgcgcgacgacgacttctatgcctacgacgaggacggcacgcgcttctcccacgacatcacgcccatcatcctggcggcgcactgccaggagtatgagatcgtgcacatcctgctgctcaagggcgcccgcatcgagcggccccacgactacttctgcaagtgcaatgagtgcaccgagaaacagcggaaagactccttcagccactcgcgctcgcgcatgaacgcctacaaaggactggcgagtgctgcctacttgtccctgtccagcgaagaccctgtcctcaccgccctggagctcagcaacgagttagccagactagccaacattgagactgaatttaagctaggacgaaccctgaggagccctttcatgaagtttgtagctcatgcagtttcttttacaatcttcttgggattattagttgtgaatgcatctgaccgatttgaaggtgttaaaaccctgccaaacgaaaccttcacagactacccaaaacaaatcttcagagtgaaaaccacacagttctcctggacagaaatgctcattatgaagtgggtcttaggaatgatttggtccgaatgcaaggaaatctgggaggaggggccacgggagtacgtgctgcacttgtggaacctgctagatttcgggatgctgtccatcttcgtggcctccttcacagcacgcttcatggccttcctgaaggccacggaggcacagctgtacgtggaccagcacgtgcaggacgacacgctgcacaatgtctcgcttccgccggaagtggcatacttcacctacgccagggacaagtggtggccttcagaccctcagatcatatcggaagggctctacgcgatagccgtcgtgctgagcttctctcgcattgcatacattctgccagccaacgagagttttgggcccctgcagatctcgctagggagaactgtgaaagatatcttcaagttcatggtcattttcatcatggtatttgtggccttcatgattgggatgttcaacctgtactcttactaccgaggtgccaaatacaacccagcgtttacaacggttgaagaaagttttaaaactttgttttggtccatattcggcttatctgaagtaatctcagtggtgctgaaatacgaccacaaattcatcgagaacattggctacgttctctacggcgtttataacgtcaccatggtggtagtgttgctcaacatgctaatagccatgataaacaactcctatcaggaaattgaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttagcagcccacatcggcgtctgtgacttctaccagcattccaaggccaggttggatgccctcgcccccatccttggtggggaggggtccccagcccactcctctaggacacgaaggggatctcctgg

SEQ ID NO: 32159 - DNA, 2987 bp, Homo sapiens
acagatgcttctccgtcatgttctctgggaaatttccccccgattaggaaaaggacggtaacacggttctgcctcggaaggcgagtttttaccactgcaacacaaagaacagaggagcgcgctttcacatcgttgcaacttaactcacttgaccagctctatacttcagcaccacggagagcggtacatccttggctaccacccatggggagccagcttctggcgactcaacaccggattccggtcatctagaggaggaacaagcctgcgtattacaccctcaatgttgaggaacagcaccttcaaaaacatgcagcgccggcacacaacgctgagggagaagggccgtcgccaggccatccggggtcccgcctacatgttcaacgagaagggcaccagtctgacgcccgaggaggagcgcttcctggactcggctgagtatggcaacatcccggtggtccggaaaatgctggaggagtccaagacccttaacttcaactgtgtggactacatggggcagaacgctctgcagctggccgtgggcaacgagcacctagaggtcacggagctgctgctgaagaaggagaacctggcacgggtgggggacgcgctgctgctggccatcagcaagggctatgtgcgcatcgtggaggccatcctcaaccacccggccttcgcgcagggccagcgcctgacgctcagcccgctggaacaggagctgcgcgacgacgacttctatgcctacgacgaggacggcacgcgcttctcccacgacatcacgcccatcatcctggcggcgcactgccaggagtatgagatcgtgcacatcctgctgctcaagggcgcccgcatcgagcggccccacgactacttctgcaagtgcaatgagtgcaccgagaaacagcggaaagactccttcagccactcgcgctcgcgcatgaacgcctacaaaggactggcgagtgctgcctacttgtccctgtccagcgaagaccctgtcctcaccgccctggagctcagcaacgagttagccagactagccaacattgagactgaatttaagaacgattacaggaagttatctatgcaatgcaaggattttgtagtgggcgtgctggacctgtgccgagacacagaagaggtggaagcaattttaaacggtgatgtgaacttccaagtctggtccgaccaccaccgtccaagtctgagccggatcaaactcgccattaaatatgaagtcaagaagttcgttgctcatcctaactgtcagcagcaattgcttaccatgtggtatgaaaatctctcaggcttacgtcaacagtctatcgctgtgaaattcctggctgtctttggagtctccataggcctcccttttctcgccatagcctattggattgctccgtgcagcaagctaggacgaaccctgaggagccctttcatgaagtttgtagctcatgcagtttcttttacaatcttcttgggattattagttgtgaatgcatctgaccgatttgaaggtgttaaaaccctgccaaacgaaaccttcacagactacccaaaacaaatcttcagagtgaaaaccacacagttctcctggacagaaatgctcattatgaagtgggtcttaggaatgatttggtccgaatgcaaggaaatctgggaggaggggccacgggagtacgtgctgcacttgtggaacctgctagatttcgggatgctgtccatcttcgtggcctccttcacagcacgcttcatggccttcctgaaggccacggaggcacagctgtacgtggaccagcacgtgcaggacgacacgctgcacaatgtctcgcttccgccggaagtggcatacttcacctacgccagggacaagtggtggccttcagaccctcagatcatatcggaagggctctacgcgatagccgtcgtgctgagcttctctcgcattgcatacattctgccagccaacgagagttttgggcccctgcagatctcgctagggagaactgtgaaagatatcttcaagttcatggtcattttcatcatggtatttgtggccttcatgattgggatgttcaacctgtactcttactaccgaggtgccaaatacaacccagcgtttacaacggttgaagaaagttttaaaactttgttttggtccatattcggcttatctgaagtaatctcagtggtgctgaaatacgaccacaaattcatcgagaacattggctacgttctctacggcgtttataacgtcaccatggtggtagtgttgctcaacatgctaatagccatgataaacaactcctatcaggaaattgaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttagcagcccacatcggcgtctgtgacttctaccagcattccaaggccaggttggatgccctcgcccccatccttggtggggaggggtccccagcccactcctctaggacacgaagggg

SEQ ID NO: 32160 - DNA, 5627 bp, Homo sapiens
tgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacgggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtgtggccatcaagatccccatcgtgtgcgtggtgctggagggcggcccgggcacgttgcacaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaagatccaagatatcgtccggaggcggcagctgctgactgtcttccgggaaggcaaggatggtcagcaggacgtggatgtggccatcttgcaggccttgctgaaagcctcacggagccaagaccactttggccacgagaactgggaccaccagctgaaactggcagtggcatggaatcgcgtggacattgcccgcagtgagatcttcatggatgagtggcagtggaagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagatgcaccacgtggcccaggtgctgcgggagctgctgggggacttcacgcagccgctttatccccggccccggcacaacgaccggctgcggctcctgctgcccgttccccacgtcaagctcaacgtgcagggagtgagcctccggtccctctacaagcgttcctcaggccatgtgaccttcaccatggaccccatccgtgaccttctcatttgggccattgtccagaaccgtcgggagctggcaggaatcatctgggctcagagccaggactgcatcgcagcggccttggcctgcagcaagatcctgaaggaactgtccaaggaggaggaggacacggacagctcggaggagatgctggcgctggcggaggagtatgagcacagagccatcggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggccttcctgaccaaggtgtggtggggccagctctccgtggacaatgggctgtggcgtgtgaccctgtgcatgctggccttcccgctgctcctcaccggcctcatctccttcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcagctcttctatgaccctgacgagtgcgggctgatgaagaaggcagccttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcagtaagacgctggggcccaagatcatcattgtgaagcggatgatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggttgacgccatggtggacctgctggacctggacccactgaagaggtcgggctccatggagcagaggttggcctccctggaggagcaggtggcccagacagcccaagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagagaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggcctggctggctcttctgtgctttccacaaataaagttcctgacacgtccagggccaggggctgtgtgacggctgcctgaagttctcctcgatcccccggtgagcttcctgcagcctgtggatgtcctgcagcccctcagccctacccccaagtttctcctctgacccatcagctccctgtcttcattttcctaaacctgggctccagcatcgtccccaagcccaccaggccaggatgcaggcatccacatgccctcctccttggcttcccctgcgtggtggtgccaatgtgccctggcacccctgcagaggctccggatggagcctggggctgcctggccactgagcactggccgaggtgatgcccacccttccctggacaggcctctgtcttccacctgacccaaagctctctagccacccccttgtccccaggtat

SEQ ID NO: 32161 - DNA, 5989 bp, Homo sapiens
tgcaccgggcacgcggcgcacgctcgggcgagatgtggatggccccgcggggccagggcggcggtgctgcgcggggacgcgggtgacgccggggcgcgggcggctccgagcagcaaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacgggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtgtggccatcaagatccccatcgtgtgcgtggtgctggagggcggcccgggcacgttgcacaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaagatccaagatatcgtccggaggcggcagctgctgactgtcttccgggaaggcaaggatggtcagcaggacgtggatgtggccatcttgcaggccttgctgaaagcctcacggagccaagaccactttggccacgagaactgggaccaccagctgaaactggcagtggcatggaatcgcgtggacattgcccgcagtgagatcttcatggatgagtggcagtggaagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcagggagtgagcctccggtccctctacaagcgttcctcaggccatgtgaccttcaccatggaccccatccgtgaccttctcatttgggccattgtccagaaccgtcgggagctggcaggaatcatctgggctcagagccaggactgcatcgcagcggccttggcctgcagcaagatcctgaaggaactgtccaaggaggaggaggacacggacagctcggaggagatgctggcgctggcggaggagtatgagcacagagccatcggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggccttcctgaccaaggtgtggtggggccagctctccgtggacaatgggctgtggcgtgtgaccctgtgcatgctggccttcccgctgctcctcaccggcctcatctccttcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcagctcttctatgaccctgacgagtgcgggctgatgaagaaggcagccttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcagtaagacgctggggcccaagatcatcattgtgaagcggatgatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggttgacgccatggtggacctgctggacctggacccactgaagaggtcgggctccatggagcagaggttggcctccctggaggagcaggtggcccagacagcccaagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagacaccctggagccactgtccacgatccagtacaacgtggtggatggcctgagggaccgccggagcttccacgggccgtacacagtgcaggccgggttgcccctgaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggcctggctggctcttctgtgctttccacaaataaagttcctgacacgtccagggccaggggctgtgtgacggctgcctgaagttctcctcgatcccccggtgagcttcctgcagcctgtggatgtcctgcagcccctcagccctacccccaagtttctcctctgacccatcagctccctgtcttcattttcctaaacctgggctccagcatcgtccccaagcccaccaggccaggatgcaggcatccacatgccctcctccttggcttcccctgcgtggtggtgccaatgtgccctggcacccctgcagaggctccggatggagcctggggctgcctggccactgagcactggccgaggtgatgcccacccttccctggacaggcctctgtcttccacctgacccaaagctctctagccacccccttgtccccaggtat

SEQ ID NO: 32162 - DNA, 6221 bp, Homo sapiens
tgtgcagaattgtacagttgcgaaaccatgtcgctggcagctggtgctggcggtggagacttccctgtgcggtgctcagtgcagctgcacccgtgggggagggagctctttctctggccctgcagtcacctgaggttgttaccattatgaacggccgctgggacccccgcatgtgcatgtactcccccagagtgtccgggggccccagccaagggacacagctcaggcagctgggaacatgtgcaggctgatgaagagaaccggatgagggcttcacatgaggaagcatgtggccaggtcctctcagaacatcagcctcatcttcctgtctctgatctatttcagcaaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacgggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtgtggccatcaagatccccatcgtgtgcgtggtgctggagggcggcccgggcacgttgcacaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaagatccaagatatcgtccggaggcggcagctgctgactgtcttccgggaaggcaaggatggtcagcaggacgtggatgtggccatcttgcaggccttgctgaaagcctcacggagccaagaccactttggccacgagaactgggaccaccagctgaaactggcagtggcatggaatcgcgtggacattgcccgcagtgagatcttcatggatgagtggcagtggaagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcagggagtgagcctccggtccctctacaagcgttcctcaggccatgtgaccttcaccatggaccccatccgtgaccttctcatttgggccattgtccagaaccgtcgggagctggcaggaatcatctgggctcagagccaggactgcatcgcagcggccttggcctgcagcaagatcctgaaggaactgtccaaggaggaggaggacacggacagctcggaggagatgctggcgctggcggaggagtatgagcacagagccatcggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggccttcctgaccaaggtgtggtggggccagctctccgtggacaatgggctgtggcgtgtgaccctgtgcatgctggccttcccgctgctcctcaccggcctcatctccttcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcagctcttctatgaccctgacgagtgcgggctgatgaagaaggcagccttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcagtaagacgctggggcccaagatcatcattgtgaagcggatgatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggttgacgccatggtggacctgctggacctggacccactgaagaggtcgggctccatggagcagaggttggcctccctggaggagcaggtggcccagacagcccaagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagacaccctggagccactgtccacgatccagtacaacgtggtggatggcctgagggaccgccggagcttccacgggccgtacacagtgcaggccgggttgcccctgaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggcctggctggctcttctgtgctttccacaaataaagttcctgacacgtccagggccaggggctgtgtgacggctgcctgaagttctcctcgatcccccggtgagcttcctgcagcctgtggatgtcctgcagcccctcagccctacccccaagtttctcctctgacccatcagctccctgtcttcattttcctaaacctgggctccagcatcgtccccaagcccaccaggccaggatgcaggcatccacatgccctcctccttggcttcccctgcgtggtggtgccaatgtgccctggcacccctgcagaggctccggatggagcctggggctgcctggccactgagcactggccgaggtgatgcccacccttccctggacaggcctctgtcttccacctgacccaaagctctctagccacccccttgtccccaggtat

SEQ ID NO: 32163 - DNA, 582 bp, Homo sapiens
gcgcgagcccgggtgcggggactgaggcggccgtcccgggagcttgtgaagcaaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccg

SEQ ID NO: 32164 - DNA, 1669 bp, Homo sapiens
agccctgcactggatcgtgaggacgctgcgggccagcggcttcagctcggaggcggacgtccccactctggcctcccagaaggccgcggaggagccggatgctgagccgggagcaggaagaagacggaggagccgggcgacagtaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagagaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggc

SEQ ID NO: 32165 - DNA, 5145 bp, Homo sapiens
atggggaagaagtggagggatgcggcggaaatggagcggggctgctccgaccgcgaggacaacgcggagagccgcagacgcagccggagcgccagccggggcaggtttgccgagtcgtggaaaaggttaagttccaagcaggggtccaccaaacgctcgggactcccgtcgcagcagacgccggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaagcgagagtatccaggtttcggttggatctattttaaggggaacctgcccccagactacagaatcagcctgattgacatcggcctggtgatcgagtacctgatgggcggggcttatcgctgcaactacacgcgcaagcgcttccggaccctctaccacaacctcttcggccccaagagggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaaaccttctta

SEQ ID NO: 32166 - DNA, 4710 bp, Homo sapiens
atgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagatgcctgccgtttttctctcttgactcccgcttgttttattcattttggggtagttgccagttagactcagttggaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaaggggaacctgcccccagactacagaatcagcctgattgacatcggcctggtgatcgagtacctgatgggcggggcttatcgctgcaactacacgcgcaagcgcttccggaccctctaccacaacctcttcggccccaagagggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaa

SEQ ID NO: 32167 - DNA, 5966 bp, Homo sapiens
agctgcagcaaaatgaaagcaacaggagctgctccggggactgcttttgccagtacccagaatcagtgctcaggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagatgcctgccgtttttctctcttgactcccgcttgttttattcattttggggtagttgccagttagactcagttggaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaaggggaacctgcccccagactacagaatcagcctgattgacatcggcctggtgatcgagtacctgatgggcggggcttatcgctgcaactacacgcgcaagcgcttccggaccctctaccacaacctcttcggccccaagagggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaaaccttcttaatatccgccacagaaggctcaagaatccagccctaaaattctctccaactccagtttttcccctttccttgaatcatacctgctttattcttagctgagcaaaacaagcaatgctttgggaggtgttaactcaaaggtgacttctgggccacagatcaagaaagcatttgatctgacccagtgccagacacaggggatttaaggcatgttcacacttgctgggcagggagggggaagagagggagaaggaagggttagagatgaatgtgtatccgcagtcacagcagaaagccatgagagcaggggaaacaaggggcttcgagcacgctccatgccaggaggcatctgttgatttctgaccattatcaagagttgtaggatgcagggctaaattgcaaaataaaataaaatagccagcgtacacaatgagatattctaaacttccattctgttttcttttcacattggctccatcactggtgactgatgaagagcatcctctttattcagtataagccggcagcaagcagttctacctaacgtcccacatccttctcatgccaacacttctgtaattgatcattataaagaaaaaacaaggtaacagtcatagttcacctgtctcttatctattcacttctggtgccacaactgtttatccttttttgaagaaaataagggaacagaaatgcctttttgtattgcaatcgaaatgaaagaagagttgatgttaaaaaaacaaaagtcaagtgatttattatatacagtgggcgttcaagtctagtcgagcaagctcaggagaatgtaattaaataattttatattttttaatttattttgtatctcacctgtcatggatgaattcattcactgaatatgtaatattgaactt

SEQ ID NO: 32168 - DNA, 5957 bp, Homo sapiens
agctgcagcaaaatgaaagcaacaggagctgctccggggactgcttttgccagtacccagaatcagtgctcaggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaagcgagagtatccaggtttcggttggatctattttaaggggaacctgcccccagactacagaatcagcctgattgacatcggcctggtgatcgagtacctgatgggcggggcttatcgctgcaactacacgcgcaagcgcttccggaccctctaccacaacctcttcggccccaagaggcccaaagccttgaaactgctgggaatggaggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaaaccttcttaatatccgccacagaaggctcaagaatccagccctaaaattctctccaactccagtttttcccctttccttgaatcatacctgctttattcttagctgagcaaaacaagcaatgctttgggaggtgttaactcaaaggtgacttctgggccacagatcaagaaagcatttgatctgacccagtgccagacacaggggatttaaggcatgttcacacttgctgggcagggagggggaagagagggagaaggaagggttagagatgaatgtgtatccgcagtcacagcagaaagccatgagagcaggggaaacaaggggcttcgagcacgctccatgccaggaggcatctgttgatttctgaccattatcaagagttgtaggatgcagggctaaattgcaaaataaaataaaatagccagcgtacacaatgagatattctaaacttccattctgttttcttttcacattggctccatcactggtgactgatgaagagcatcctctttattcagtataagccggcagcaagcagttctacctaacgtcccacatccttctcatgccaacacttctgtaattgatcattataaagaaaaaacaaggtaacagtcatagttcacctgtctcttatctattcacttctggtgccacaactgtttatccttttttgaagaaaataagggaacagaaatgcctttttgtattgcaatcgaaatgaaagaagagttgatgttaaaaaaacaaaagtcaagtgatttattatatacagtgggcgttcaagtctagtcgagcaagctcaggagaatgtaattaaataattttatattttttaatttattttgtatctcacctgtcatggatgaattcattcactgaatatgtaatattgaactt

SEQ ID NO: 32169 - DNA, 5996 bp, Homo sapiens
agctgcagcaaaatgaaagcaacaggagctgctccggggactgcttttgccagtacccagaatcagtgctcaggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagatgcctgccgtttttctctcttgactcccgcttgttttattcattttggggtagttgccagttagactcagttggaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaaggggaacctgcccccagactacagaatcagcctgattgacatcggcctggtgatcgagtacctgatgggcggggcttatcgctgcaactacacgcgcaagcgcttccggaccctctaccacaacctcttcggccccaagaggcccaaagccttgaaactgctgggaatggaggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaaaccttcttaatatccgccacagaaggctcaagaatccagccctaaaattctctccaactccagtttttcccctttccttgaatcatacctgctttattcttagctgagcaaaacaagcaatgctttgggaggtgttaactcaaaggtgacttctgggccacagatcaagaaagcatttgatctgacccagtgccagacacaggggatttaaggcatgttcacacttgctgggcagggagggggaagagagggagaaggaagggttagagatgaatgtgtatccgcagtcacagcagaaagccatgagagcaggggaaacaaggggcttcgagcacgctccatgccaggaggcatctgttgatttctgaccattatcaagagttgtaggatgcagggctaaattgcaaaataaaataaaatagccagcgtacacaatgagatattctaaacttccattctgttttcttttcacattggctccatcactggtgactgatgaagagcatcctctttattcagtataagccggcagcaagcagttctacctaacgtcccacatccttctcatgccaacacttctgtaattgatcattataaagaaaaaacaaggtaacagtcatagttcacctgtctcttatctattcacttctggtgccacaactgtttatccttttttgaagaaaataagggaacagaaatgcctttttgtattgcaatcgaaatgaaagaagagttgatgttaaaaaaacaaaagtcaagtgatttattatatacagtgggcgttcaagtctagtcgagcaagctcaggagaatgtaattaaataattttatattttttaatttattttgtatctcacctgtcatggatgaattcattcactgaatatgtaatattgaactt

SEQ ID NO: 32170 - DNA, 6269 bp, Homo sapiens
tccgaccacaggctgttttgtgcaggctgtccctcttcttcaaaatcgtgcatcccctccccgaagcagcaggcagtgtgcctccattcagccacatttggtatgcatgagcacggctgcagagagaggggaggtggctgttttaagaaggttcaggggctcaggcaaggctacttgactagtcttccaagttccaggaagcctctgccctaatggaatttgcaggtgtggagatgaccatgggatgccagagccgtgggggaccgtttattttctaggcattgctcaggttttcagtttcttgttttcctggtggaatttggaaggggtcatgaatcaggctgatgctcctcgacccctaaactggaccatccggaagctgtgccacgcagcctttcttccatctgtcagacttctgaaggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaaggggaacctgcccccagactacagaatcagcctgattgacatcggcctggtgatcgagtacctgatgggcggggcttatcgctgcaactacacgcgcaagcgcttccggaccctctaccacaacctcttcggccccaagaggcccaaagccttgaaactgctgggaatggaggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaaaccttcttaatatccgccacagaaggctcaagaatccagccctaaaattctctccaactccagtttttcccctttccttgaatcatacctgctttattcttagctgagcaaaacaagcaatgctttgggaggtgttaactcaaaggtgacttctgggccacagatcaagaaagcatttgatctgacccagtgccagacacaggggatttaaggcatgttcacacttgctgggcagggagggggaagagagggagaaggaagggttagagatgaatgtgtatccgcagtcacagcagaaagccatgagagcaggggaaacaaggggcttcgagcacgctccatgccaggaggcatctgttgatttctgaccattatcaagagttgtaggatgcagggctaaattgcaaaataaaataaaatagccagcgtacacaatgagatattctaaacttccattctgttttcttttcacattggctccatcactggtgactgatgaagagcatcctctttattcagtataagccggcagcaagcagttctacctaacgtcccacatccttctcatgccaacacttctgtaattgatcattataaagaaaaaacaaggtaacagtcatagttcacctgtctcttatctattcacttctggtgccacaactgtttatccttttttgaagaaaataagggaacagaaatgcctttttgtattgcaatcgaaatgaaagaagagttgatgttaaaaaaacaaaagtcaagtgatttattatatacagtgggcgttcaagtctagtcgagcaagctcaggagaatgtaattaaataattttatattttttaatttattttgtatctcacctgtcatggatgaattcattcactgaatatgtaatattgaactt

SEQ ID NO: 32171 - DNA, 4618 bp, Homo sapiens
tccgaccacaggctgttttgtgcaggctgtccctcttcttcaaaatcgtgcatcccctccccgaagcagcaggcagtgtgcctccattcagccacatttggtatgcatgagcacggctgcagagagaggggaggtggctgttttaagaaggttcaggggctcaggcaaggctacttgactagtcttccaagttccaggaagcctctgccctaatggaatttgcaggtgtggagatgaccatgggatgccagagccgtgggggaccgtttattttctaggcattgctcaggttttcagtttcttgttttcctggtggaatttggaaggggtcatgaatcaggctgatgctcctcgacccctaaactggaccatccggaagctgtgccacgcagcctttcttccatctgtcagacttctgaaggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaaggggaacctgcccccagactacagaatcagcctgattgacatcggcctggtgatcgagtacctgatgggcggggcttatcgctgcaactacacgcgcaagcgcttccggaccctctaccacaacctcttcggccccaagaggcccaaagccttgaaactgctgggaatggaggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcagagcatcctctttattcagtataagccggcagcaagcagttctacctaacgtcccacatccttctcatgccaacacttctgtaattgatcattataaagaaaaaacaaggtaacagtcatagttcacctgtctcttatctattcacttctggtgccacaactgtttatccttttttgaagaaaataagggaacagaaatgcctttttgtattgcaatcgaaatgaaagaagagttgatgttaaaaaaacaaaagtcaagtgatttattatatacagtgggcgttcaagtctagtcgagcaagctcaggagaatgtaattaaataattttatattttttaatttattttgtatctcacctgtcatggatgaattcattcactgaatatgtaatattgaacttaaaaaaaaaaaaaaaaaaa

SEQ ID NO: 32172 - DNA, 4669 bp, Homo sapiens
gtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaagcgagagtatccaggtttcggttggatctattttaaggggaacctgcccccagactacagaatcagcctgattgacatcggcctggtgatcgagtacctgatgggcggggcttatcgctgcaactacacgcgcaagcgcttccggaccctctaccacaacctcttcggccccaagagggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaa

SEQ ID NO: 32173 - DNA, 4701 bp, Homo sapiens
atgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaaggggaacctgcccccagactacagaatcagcctgattgacatcggcctggtgatcgagtacctgatgggcggggcttatcgctgcaactacacgcgcaagcgcttccggaccctctaccacaacctcttcggccccaagaggcccaaagccttgaaactgctgggaatggaggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccgtaagcaagtttatgattctcatacaccaaagtcagctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaa

SEQ ID NO: 32174 - DNA, 4740 bp, Homo sapiens
atgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagatgcctgccgtttttctctcttgactcccgcttgttttattcattttggggtagttgccagttagactcagttggaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaaggggaacctgcccccagactacagaatcagcctgattgacatcggcctggtgatcgagtacctgatgggcggggcttatcgctgcaactacacgcgcaagcgcttccggaccctctaccacaacctcttcggccccaagaggcccaaagccttgaaactgctgggaatggaggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaa

SEQ ID NO: 32175 - DNA, 4701 bp, Homo sapiens
atgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaagcgagagtatccaggtttcggttggatctattttaaggggaacctgcccccagactacagaatcagcctgattgacatcggcctggtgatcgagtacctgatgggcggggcttatcgctgcaactacacgcgcaagcgcttccggaccctctaccacaacctcttcggccccaagaggcccaaagccttgaaactgctgggaatggaggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaa

SEQ ID NO: 32176 - DNA, 5205 bp, Homo sapiens
atggggaagaagtggagggatgcggcggaaatggagcggggctgctccgaccgcgaggacaacgcggagagccgcagacgcagccggagcgccagccggggcaggtttgccgagtcgtggaaaaggttaagttccaagcaggggtccaccaaacgctcgggactcccgtcgcagcagacgccggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagatgcctgccgtttttctctcttgactcccgcttgttttattcattttggggtagttgccagttagactcagttggaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaaggggaacctgcccccagactacagaatcagcctgattgacatcggcctggtgatcgagtacctgatgggcggggcttatcgctgcaactacacgcgcaagcgcttccggaccctctaccacaacctcttcggccccaagaggcccaaagccttgaaactgctgggaatggaggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaa

SEQ ID NO: 32177 - DNA, 2121 bp, Homo sapiens
aaatgaaagcaacaggagctgctccggggactgcttttgccagtacccagaatcagtgctcaggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagttttcatagttacaaaacagctcatgtggaccttcaggataaaagacaggtgaagactgccttagagcaagcagagtggcagccgggaagaggaatgtttgatcatgataatctcatgcaaagtacataaaggggtatatatatgtatgtatatatgtatgtatgtttatatgtgtttatatgcatacatatacatatgtgttttatatatatatatatatatatatttttttttttttttgagacaaagcctcactctgtcactgaggctttggtgcaatggcaccctcagggctcactgcagcctcgacttcccaggctcaagtgattctcctacctcagggtcctgagtagctgggactacaggcacatgcatcaaaccccactaatttttaaaaatatttttgtagagacaggttcttgctatatttcccaggctgatcctgaattcctgggctcaaatgatcctcccgcctcggtctctcttttattctctctctctccctctttttccctctctttcatagattctttctcttttctctcccctctctctctccttcctcccccataccacttccttccctcttcctggggccatgtgatctctcccctccatggtaccctctgctcctttgttttctacctgcatatggcttttttgttcattggcttaccttcctcacatggttggtctggaggaccaccactaacagaggcttcattccccaagtatgcatgccctggaagcccatctcccagttactggccttgggctcaggatctccacttcaatcccaggaaagcaaatctggctcactgcaggtctgacatccatgtaagtccagccagctttgaaaaaagtcaagcagggctgcgccttctatgcagtggatgggtctgttctctgacaggggagaggggatagggcggacaccatgagagttttcagtacacatgccacagtgacctctttggccagcttaaaggatttcccattcaatctactcatccactgcccagcttctgtcctttgtcctccgattactagatagaaaagcaaagcaagaaggcaatgccccaaaagaaggccagtcgatgggcattaatacaggattgctgtgaaaatgcctcgagcactgagaatgcacaaaatagatttgtttagctgtattgaaaacaaacagaaaaaaatacagtttgccatattaatttaatatattctgcattctcagtccctaggaaaagatacactatgcac

SEQ ID NO: 32178 - DNA, 4053 bp, Homo sapiens
ggtctggaagcagagccggcggagggagcgccggggccctgggctgcaggaggttgcggcggccgcggcagcatggtggtgccggagaaggagcagagctggatccccaagatcttcaagaagaagacctgcacgacgttcatagttgactccacagatccgggagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagagg

SEQ ID NO: 32179 - DNA, 3273 bp, Homo sapiens
aggaggttgcggcggccgcggcagcatggtggtgccggagaaggagcagagctggatccccaagatcttcaagaagaagacctgcacgacgttcatagttgactccacagatccgggggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccagtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagagg

SEQ ID NO: 32180 - DNA, 3618 bp, Homo sapiens
ggtctggaagcagagccggcggagggagcgccggggccctgggctgcaggaggttgcggcggccgcggcagcatggtggtgccggagaaggagcagagctggatccccaagatcttcaagaagaagacctgcacgacgttcatagttgactccacagatccgggagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagagg

SEQ ID NO: 32181 - DNA, 3929 bp, Homo sapiens
gaggccaccatgcaggatgtccaaggcccccgtcccggaagccccggggatgctgaagaccggcgggagctgggcttgcacaggggcgaggtcaactttggagggtctgggaagaagcgaggcaagtttgtacgggtgccgagcggagtggccccgtctgtgctctttgacctgctgcttgctgagtggcacctgccggcccccaacctggtggtgtccctggtgggtgaggagcagcctttcgccatgaagtcctggctgcgggatgtgctgcgcaaggggctggtgaaggcggctcagagcacaggagcctggatcctgaccagtgccctccgcgtgggcctggccaggcatgtcgggcaggccgtgcgcgaccactcgctggccagcacgtccaccaaggtccgtgtggttgctgtcggcatggcctcgctgggccgcgtcctgcaccgccgcattctggaggaggcccaggaggattttcctgtccactaccctgaggatgacggcggcagccagggccccctctgttcactggacagcaacctctcccacttcatcctggtggagccaggccccccggggaagggcgatgggctgacggagctgcggctgaggctggagaagcacatctcggagcagagggcgggctacgggggcactggcagcatcgagatccctgtcctctgcttgctggtcaatggtgatcccaacaccttggagaggatctccagggccgtggagcaggctgccccgtggctgatcctggtaggctcggggggcatcgccgatgtgcttgctgccctagtgaaccagccccacctcctggtgcccaaggtggccgagaagcagtttaaggagaagttccccagcaagcatttctcttgggaggacatcgtgcgctggaccaagctgctgcagaacatcacctcacaccagcacctgctcaccgtgtatgacttcgagcaggagggctccgaggagctggacacggtcatcctgaaggcgctggtgaaagcctgcaagagccacagccaggagcctcaggactatctggatgagctcaagctggccgtggcctgggaccgcgtggacatcgccaagagtgagatcttcaatggggacgtggagtggaagtcctgtgacctggaggaggtgatggtggacgccctggtcagcaacaagcccgagtttgtgcgcctctttgtggacaacggcgcagacgtggccgacttcctgacgtatgggcggctgcaggagctctaccgctccgtgtcacgcaagagcctgctcttcgacctgctgcagcggaagcaggaggaggcccggctgacgctggccggcctgggcacccagcaggcccgggagccacccgcggggccaccggccttctccctgcacgaggtctcccgcgtactcaaggacttcctgcaggacgcctgccgaggcttctaccaggacggccggccaggggaccgcaggagggcggagaagggcccggccaagcggcccacgggccagaagtggctgctggacctgaaccagaagagcgagaacccctggcgggacctgttcctgtgggccgtgctgcagaaccgccacgagatggccacctacttctgggccatgggccaggaaggtgtggcagccgcactggccgcctgcaaaatcctcaaagagatgtcgcacctggagacggaggccgaggcggcccgagccacgcgcgaggcgaaatacgagcggctggcccttgacctcttctccgagtgctacagcaacagtgaggcccgcgccttcgccctgctggtgcgccggaaccgctgctggagcaagaccacctgcctgcacctggccaccgaggctgacgccaaggccttctttgcccacgacggcgttcaggccttcctgaccaggatctggtggggggacatggccgcaggcacgcccatcctgcggctgctaggagccttcctctgccccgccctcgtctataccaacctcatcaccttcagtgaggaagctcccctgaggacaggcctggaggacctgcaggacctggacagcctggacacggagaagagcccgctgtatggcctgcagagccgggtggaggagctggtggaggcgccgagggctcagggtgaccgaggcccacgtgctgtcttcctgctcacacgctggcggaaattctggggcgctcccgtgactgtgttcctggggaacgtggtcatgtacttcgccttcctcttcctgttcacctacgtcctgctggtggacttcaggccgcccccccagggcccctcagggcccgaggtcaccctctacttctgggtctttacgctggtgctggaggaaatccggcagggcttcttcacagacgaggacacacacctggtgaagaagttcacactgtatgtgggggacaactggaacaagtgtgacatggtggccatcttcctgttcatcgtgggtgtcacctgcaggatgctgccgtcggcgtttgaggctggccgcacagtcctcgccatggacttcatggtgttcacgctgcggctgatccatatctttgccatacacaagcagctgggccccaagatcatcgtggtagagcgcatgatgaaggacgtcttcttcttcctcttctttctgagcgtgtggctcgtggcctacggtgtcaccacccaggcgctgctgcacccccatgacggccgcctggagtggatcttccgccgggtgctctaccggccctacctgcagatcttcggccagatcccactggacgagattgatgaagcccgtgtgaactgctccacccacccactgctgctggaggactcaccatcctgccccagcctctatgccaactggctggtcatcctcctgctggtcaccttcctgttggtcaccaatgtgctgctcatgaacctgctcatcgccatgttcagctacacgttccaggtggtgcagggcaacgcagacatgttctggaagttccagcgctacaacctgattgtggagtaccacgagcgccccgccctggccccgcccttcatcctgctcagccacctgagcctgacgctccgccgggtcttcaagaaggaggctgagcacaagcgggagcacctggagagagacctgccagaccccctggaccagaaggtcgtcacctgggagacagtccagaaggagaacttcctgagcaagatggagaagcggaggagggacagcgagggggaggtgctgcggaaaaccgcccacagagtggacttcattgccaagtacctcgggggtctgagagagcaagaaaagcgcatcaagtgtctggagtcacagatcaactactgctcggtgctcgtgtcctccgtggctgacgtgctggcccagggtggcggcccccggagctctcagcactgtggcgagggaagccagctggtggctgctgaccacagaggtggtttagatggctgggaacaacccggggctggccagcctccctcggacacctgagctgcttggcctgccacgtgtggggccacctctcctcagctggccaccctgcacgttgtgcactgacctttgccgacctccagcggaaccccccagggggcaccagccccccagcagacaatggccctcctggtgcctcaccacagaccctcacccaaaggaaccgctccttgtccctcctggcctccccggaggcacagcagtgtcatggggctgtctcccctgacaggcacaactccccgggcagaaaacgtgccccaccgcatccctacctggaaactgaccagcctgcactgtggaaaagctggccctgtggcgtgacgggggagcacccccatccagactgcgaagctgctctggggtctgcacccacccctgccctgacttgtgttgcctgacaagagactcatctttttttgaaa

SEQ ID NO: 32182 - DNA, 2625 bp, Homo sapiens
gaggccaccatgcaggatgtccaaggcccccgtcccggaagccccggggatgctgaagaccggcgggagctgggcttgcacaggggcgaggtcaactttggagggtctgggaagaagcgaggcaagtttgtacgggtgccgagcggagtggccccgtctgtgctctttgacctgctgcttgctgagtggcacctgccggcccccaacctggtggtgtccctggtgggtgaggagcagcctttcgccatgaagtcctggctgcgggatgtgctgcgcaaggggctggtgaaggcggctcagagcacaggagcctggatcctgaccagtgccctccgcgtgggcctggccaggcatgtcgggcaggccgtgcgcgaccactcgctggccagcacgtccaccaaggtccgtgtggttgctgtcggcatggcctcgctgggccgcgtcctgcaccgccgcattctggaggaggcccaggaggattttcctgtccactaccctgaggatgacggcggcagccagggccccctctgttcactggacagcaacctctcccacttcatcctggtggagccaggccccccggggaagggcgatgggctgacggagctgcggctgaggctggagaagcacatctcggagcagagggcgggctacgggggcactggcagcatcgagatccctgtcctctgcttgctggtcaatggtgatcccaacaccttggagaggatctccagggccgtggagcaggctgccccgtggctgatcctggtaggctcggggggcatcgccgatgtgcttgctgccctagtgaaccagccccacctcctggtgcccaaggtggccgagaagcagtttaaggagaagttccccagcaagcatttctcttgggaggacatcgtgcgctggaccaagctgctgcagaacatcacctcacaccagcacctgctcaccgtgtatgacttcgagcaggagggctccgaggagctggacacggtcatcctgaaggcgctggtgaaagcctgcaagagccacagccaggagcctcaggactatctggatgagctcaagctggccgtggcctgggaccgcgtggacatcgccaagagtgagatcttcaatggggacgtggagtggaagtcctgtgacctggaggaggtgatggtggacgccctggtcagcaacaagcccgagtttgtgcgcctctttgtggacaacggcgcagacgtggccgacttcctgacgtatgggcggctgcaggagctctaccgctccgtgtcacgcaagagcctgctcttcgacctgctgcagcggaagcaggaggaggcccggctgacgctggccggcctgggcacccagcaggcccgggagccacccgcggggccaccggccttctccctgcacgaggtctcccgcgtactcaaggacttcctgcaggacgcctgccgaggcttctaccaggacggccggccaggggaccgcaggagggcggagaagggcccggccaagcggcccacgggccagaagtggctgctggacctgaaccagaagagcgagaacccctggcgggacctgttcctgtgggccgtgctgcagaaccgccacgagatggccacctacttctgggccatgggccaggaaggtgtggcagccgcactggccgcctgcaaaatcctcaaagagatgtcgcacctggagacggaggccgaggcggcccgagccacgcgcgaggcgaaatacgagcggctggcccttgacctcttctccgagtgctacagcaacagtgaggcccgcgccttcgccctgctggtgcgccggaaccgctgctggagcaagaccacctgcctgcacctggccaccgaggctgacgccaaggccttctttgcccacgacggcgttcaggccttcctgaccaggatctggtggggggacatggccgcaggcacgcccatcctgcggctgctaggagccttcctctgccccgccctcgtctataccaacctcatcaccttcagtgaggaagctcccctgaggacaggcctggaggacctgcaggacctggacagcctggacacggagaagagcccgctgtatggcctgcagagccgggtggaggagctggtggaggcgccgagggctcagggtgaccgaggcccacgtgctgtcttcctgctcacacgctggcggaaattctggggcgctcccgtgactgtgttcctggggaacgtggtcatgtacttcgccttcctcttcctgttcacctacgtcctgctggtggacttcaggccgcccccccagggcccctcagggcccgaggtcaccctctacttctgggtctttacgctggtgctggaggaaatccggcagggcttcttcacagacgaggacacacacctggtgaagaagttcacactgtatgtgggggacaactggaacaagtgtgacatggtggccatcttcctgttcatcgtgggtgtcacctgcaggatgctgccgtcggcgtttgaggctggccgcacagtcctcgccatggacttcatggtgttcacgctgcggctgatccatatctttgccatacacaagcagctgggccccaagatcatcgtggtagagcgcatgaagccagtg

SEQ ID NO: 32183 - DNA, 3932 bp, Homo sapiens
gaggccaccatgcaggatgtccaaggcccccgtcccggaagccccggggatgctgaagaccggcgggagctgggcttgcacaggggcgaggtcaactttggagggtctgggaagaagcgaggcaagtttgtacgggtgccgagcggagtggccccgtctgtgctctttgacctgctgcttgctgagtggcacctgccggcccccaacctggtggtgtccctggtgggtgaggagcagcctttcgccatgaagtcctggctgcgggatgtgctgcgcaaggggctggtgaaggcggctcagagcacaggagcctggatcctgaccagtgccctccgcgtgggcctggccaggcatgtcgggcaggccgtgcgcgaccactcgctggccagcacgtccaccaaggtccgtgtggttgctgtcggcatggcctcgctgggccgcgtcctgcaccgccgcattctggaggaggcccaggtgcacgaggattttcctgtccactaccctgaggatgacggcggcagccagggccccctctgttcactggacagcaacctctcccacttcatcctggtggagccaggccccccggggaagggcgatgggctgacggagctgcggctgaggctggagaagcacatctcggagcagagggcgggctacgggggcactggcagcatcgagatccctgtcctctgcttgctggtcaatggtgatcccaacaccttggagaggatctccagggccgtggagcaggctgccccgtggctgatcctggtaggctcggggggcatcgccgatgtgcttgctgccctagtgaaccagccccacctcctggtgcccaaggtggccgagaagcagtttaaggagaagttccccagcaagcatttctcttgggaggacatcgtgcgctggaccaagctgctgcagaacatcacctcacaccagcacctgctcaccgtgtatgacttcgagcaggagggctccgaggagctggacacggtcatcctgaaggcgctggtgaaagcctgcaagagccacagccaggagcctcaggactatctggatgagctcaagctggccgtggcctgggaccgcgtggacatcgccaagagtgagatcttcaatggggacgtggagtggaagtcctgtgacctggaggaggtgatggtggacgccctggtcagcaacaagcccgagtttgtgcgcctctttgtggacaacggcgcagacgtggccgacttcctgacgtatgggcggctgcaggagctctaccgctccgtgtcacgcaagagcctgctcttcgacctgctgcagcggaagcaggaggaggcccggctgacgctggccggcctgggcacccagcaggcccgggagccacccgcggggccaccggccttctccctgcacgaggtctcccgcgtactcaaggacttcctgcaggacgcctgccgaggcttctaccaggacggccggccaggggaccgcaggagggcggagaagggcccggccaagcggcccacgggccagaagtggctgctggacctgaaccagaagagcgagaacccctggcgggacctgttcctgtgggccgtgctgcagaaccgccacgagatggccacctacttctgggccatgggccaggaaggtgtggcagccgcactggccgcctgcaaaatcctcaaagagatgtcgcacctggagacggaggccgaggcggcccgagccacgcgcgaggcgaaatacgagcggctggcccttgacctcttctccgagtgctacagcaacagtgaggcccgcgccttcgccctgctggtgcgccggaaccgctgctggagcaagaccacctgcctgcacctggccaccgaggctgacgccaaggccttctttgcccacgacggcgttcaggccttcctgaccaggatctggtggggggacatggccgcaggcacgcccatcctgcggctgctaggagccttcctctgccccgccctcgtctataccaacctcatcaccttcagtgaggaagctcccctgaggacaggcctggaggacctgcaggacctggacagcctggacacggagaagagcccgctgtatggcctgcagagccgggtggaggagctggtggaggcgccgagggctcagggtgaccgaggcccacgtgctgtcttcctgctcacacgctggcggaaattctggggcgctcccgtgactgtgttcctggggaacgtggtcatgtacttcgccttcctcttcctgttcacctacgtcctgctggtggacttcaggccgcccccccagggcccctcagggcccgaggtcaccctctacttctgggtctttacgctggtgctggaggaaatccggcagggcttcttcacagacgaggacacacacctggtgaagaagttcacactgtatgtgggggacaactggaacaagtgtgacatggtggccatcttcctgttcatcgtgggtgtcacctgcaggatgctgccgtcggcgtttgaggctggccgcacagtcctcgccatggacttcatggtgttcacgctgcggctgatccatatctttgccatacacaagcagctgggccccaagatcatcgtggtagagcgcatgatgaaggacgtcttcttcttcctcttctttctgagcgtgtggctcgtggcctacggtgtcaccacccaggcgctgctgcacccccatgacggccgcctggagtggatcttccgccgggtgctctaccggccctacctgcagatcttcggccagatcccactggacgagattgatgaagcccgtgtgaactgctccacccacccactgctgctggaggactcaccatcctgccccagcctctatgccaactggctggtcatcctcctgctggtcaccttcctgttggtcaccaatgtgctgctcatgaacctgctcatcgccatgttcagctacacgttccaggtggtgcagggcaacgcagacatgttctggaagttccagcgctacaacctgattgtggagtaccacgagcgccccgccctggccccgcccttcatcctgctcagccacctgagcctgacgctccgccgggtcttcaagaaggaggctgagcacaagcgggagcacctggagagagacctgccagaccccctggaccagaaggtcgtcacctgggagacagtccagaaggagaacttcctgagcaagatggagaagcggaggagggacagcgagggggaggtgctgcggaaaaccgcccacagagtggacttcattgccaagtacctcgggggtctgagagagcaagaaaagcgcatcaagtgtctggagtcacagatcaactactgctcggtgctcgtgtcctccgtggctgacgtgctggcccagggtggcggcccccggagctctcagcactgtggcgagggaagccagctggtggctgctgaccacagaggtggtttagatggctgggaacaacccggggctggccagcctccctcggacacctgagctgcttggcctgccacgtgtggggccacctctcctcagctggccaccctgcacgttgtgcactgacctttgccgacctccagcggaaccccccagggggcaccagccccccagcagacaatggccctcctggtgcctcaccacagaccctcacccaaaggaaccgctccttgtccctcctggcctccccggaggcacagcagtgtcatggggctgtctcccctgacaggcacaactccccgggcagaaaacgtgccccaccgcatccctacctggaaactgaccagcctgcactgtggaaaagctggccctgtggcgtgacgggggagcacccccatccagactgcgaagctgctctggggtctgcacccacccctgccctgacttgtgttgcctgacaagagactcatctttttttg

SEQ ID NO: 32184 - DNA, 3902 bp, Homo sapiens
cccggaagccccggggatgctgaagaccggcgggagctgggcttgcacaggggcgaggtcaactttggagggtctgggaagaagcgaggcaagtttgtacgggtgccgagcggagtggccccgtctgtgctctttgacctgctgcttgctgagtggcacctgccggcccccaacctggtggtgtccctggtgggtgaggagcagcctttcgccatgaagtcctggctgcgggatgtgctgcgcaaggggctggtgaaggcggctcagagcacaggagcctggatcctgaccagtgccctccgcgtgggcctggccaggcatgtcgggcaggccgtgcgcgaccactcgctggccagcacgtccaccaaggtccgtgtggttgctgtcggcatggcctcgctgggccgcgtcctgcaccgccgcattctggaggaggcccaggtgcacgaggattttcctgtccactaccctgaggatgacggcggcagccagggccccctctgttcactggacagcaacctctcccacttcatcctggtggagccaggccccccggggaagggcgatgggctgacggagctgcggctgaggctggagaagcacatctcggagcagagggcgggctacgggggcactggcagcatcgagatccctgtcctctgcttgctggtcaatggtgatcccaacaccttggagaggatctccagggccgtggagcaggctgccccgtggctgatcctggtaggctcggggggcatcgccgatgtgcttgctgccctagtgaaccagccccacctcctggtgcccaaggtggccgagaagcagtttaaggagaagttccccagcaagcatttctcttgggaggacatcgtgcgctggaccaagctgctgcagaacatcacctcacaccagcacctgctcaccgtgtatgacttcgagcaggagggctccgaggagctggacacggtcatcctgaaggcgctggtgaaagcctgcaagagccacagccaggagcctcaggactatctggatgagctcaagctggccgtggcctgggaccgcgtggacatcgccaagagtgagatcttcaatggggacgtggagtggaagtcctgtgacctggaggaggtgatggtggacgccctggtcagcaacaagcccgagtttgtgcgcctctttgtggacaacggcgcagacgtggccgacttcctgacgtatgggcggctgcaggagctctaccgctccgtgtcacgcaagagcctgctcttcgacctgctgcagcggaagcaggaggaggcccggctgacgctggccggcctgggcacccagcaggcccgggagccacccgcggggccaccggccttctccctgcacgaggtctcccgcgtactcaaggacttcctgcaggacgcctgccgaggcttctaccaggacggccggccaggggaccgcaggagggcggagaagggcccggccaagcggcccacgggccagaagtggctgctggacctgaaccagaagagcgagaacccctggcgggacctgttcctgtgggccgtgctgcagaaccgccacgagatggccacctacttctgggccatgggccaggaaggtgtggcagccgcactggccgcctgcaaaatcctcaaagagatgtcgcacctggagacggaggccgaggcggcccgagccacgcgcgaggcgaaatacgagcggctggcccttgacctcttctccgagtgctacagcaacagtgaggcccgcgccttcgccctgctggtgcgccggaaccgctgctggagcaagaccacctgcctgcacctggccaccgaggctgacgccaaggccttctttgcccacgacggcgttcaggccttcctgaccaggatctggtggggggacatggccgcaggcacgcccatcctgcggctgctaggagccttcctctgccccgccctcgtctataccaacctcatcaccttcagtgaggaagctcccctgaggacaggcctggaggacctgcaggacctggacagcctggacacggagaagagcccgctgtatggcctgcagagccgggtggaggagctggtggaggcgccgagggctcagggtgaccgaggcccacgtgctgtcttcctgctcacacgctggcggaaattctggggcgctcccgtgactgtgttcctggggaacgtggtcatgtacttcgccttcctcttcctgttcacctacgtcctgctggtggacttcaggccgcccccccagggcccctcagggcccgaggtcaccctctacttctgggtctttacgctggtgctggaggaaatccggcagggcttcttcacagacgaggacacacacctggtgaagaagttcacactgtatgtgggggacaactggaacaagtgtgacatggtggccatcttcctgttcatcgtgggtgtcacctgcaggatgctgccgtcggcgtttgaggctggccgcacagtcctcgccatggacttcatggtgttcacgctgcggctgatccatatctttgccatacacaagcagctgggccccaagatcatcgtggtagagcgcatgatgaaggacgtcttcttcttcctcttctttctgagcgtgtggctcgtggcctacggtgtcaccacccaggcgctgctgcacccccatgacggccgcctggagtggatcttccgccgggtgctctaccggccctacctgcagatcttcggccagatcccactggacgagattgatgaagcccgtgtgaactgctccacccacccactgctgctggaggactcaccatcctgccccagcctctatgccaactggctggtcatcctcctgctggtcaccttcctgttggtcaccaatgtgctgctcatgaacctgctcatcgccatgttcagctacacgttccaggtggtgcagggcaacgcagacatgttctggaagttccagcgctacaacctgattgtggagtaccacgagcgccccgccctggccccgcccttcatcctgctcagccacctgagcctgacgctccgccgggtcttcaagaaggaggctgagcacaagcgggagcacctggagagagacctgccagaccccctggaccagaaggtcgtcacctgggagacagtccagaaggagaacttcctgagcaagatggagaagcggaggagggacagcgagggggaggtgctgcggaaaaccgcccacagagtggacttcattgccaagtacctcgggggtctgagagagcaagaaaagcgcatcaagtgtctggagtcacagatcaactactgctcggtgctcgtgtcctccgtggctgacgtgctggcccagggtggcggcccccggagctctcagcactgtggcgagggaagccagctggtggctgctgaccacagaggtggtttagatggctgggaacaacccggggctggccagcctccctcggacacctgagctgcttggcctgccacgtgtggggccacctctcctcagctggccaccctgcacgttgtgcactgacctttgccgacctccagcggaaccccccagggggcaccagccccccagcagacaatggccctcctggtgcctcaccacagaccctcacccaaaggaaccgctccttgtccctcctggcctccccggaggcacagcagtgtcatggggctgtctcccctgacaggcacaactccccgggcagaaaacgtgccccaccgcatccctacctggaaactgaccagcctgcactgtggaaaagctggccctgtggcgtgacgggggagcacccccatccagactgcgaagctgctctggggtctgcacccacccctgccctgacttgtgttgcctgacaagagactcatctttttttgaaa

SEQ ID NO: 32185 - DNA, 3740 bp, Homo sapiens
agacaaggagcttgagatcaacctgagcaacatagggagaccccatctctacaaataactgaaaaaaaaaaaaagctaggtgtggtggtacatacctgtggtcccatctactcaggaggctgagacaggaggattgcgtgagcctggctcaagacaaggcgtgccggtcgtggggctggtggtggaaggcggtcccaacgtcatcctgtcagtgtgggagactgtcaaggacaaggacccagtggtggtgtgtgagggcacaggtagggcggctgacctcctggccttcacacacaaacacctggcagatgaagggatgctgcgacctcaggtgaaagaggagatcatctgcatgattcagaacactttcaactttagtcttaaacagtccaagcaccttttccaaattctaatggagtgtatggttcacagggattgtattaccatatttgatgctgactctgaagagcagcaagacctggacttagcaatcctaacagctttgctgaagggcacaaatttatcagcgtcagagcaattaaatctggcaatggcttgggacagggtggacattgccaagaaacatatcctaatttatgaacaacactggaagcctgatgccctggaacaagcaatgtcagatgctttagtgatggatcgggtggattttgtgaagctcttaatagaatatggagtgaacctccatcgctttcttaccatccctcgactggaagagctctacaatacaaaacaaggacctactaatacactcttgcatcatctcgtccaagatgtgaaacagcatacccttctttcaggctaccgaataaccttgattgacattggattagtagtagaatacctcattggtagagcatatcgcagcaactacactagaaaacatttcagagccctctacaacaacctctacagaaaatacaagcaccagagacactcctcaggaaatagaaatgagtctgcagaaagtacgctgcactcccagttcattagaactgcacagccatacaaattcaaggaaaagtctatagtccttcataaatcaaggaagaagtcaaaagaacaaaatgtatcagatgaccctgagtctactggctttctttacccttacaatgacctgctggtttgggctgtgctgatgaaaaggcagaagatggctatgttcttctggcagcatggagaggaggccacggttaaagccgtgattgcgtgtatcctctaccgggcaatggcccatgaagctaaggagagtcacatggtggatgatgcctcagaagagttgaagaattactcaaaacagtttggccagctggctctggacttgttggagaaggcattcaagcagaatgagcgcatggccatgacgctgttgacgtatgaactcaggaactggagcaattcgacctgccttaaactggccgtgtcgggaggattacgaccctttgtttcacatacttgtacccagatgctactgacagacatgtggatggggaggctgaaaatgaggaaaaactcttggttaaagattattataagcattattttaccacccaccattttgacactggaatttaaaagcaaagctgagatgtcacatgttccccagtcccaggacttccaatttatgtggtattacagtgaccagaacgccagcagttccaaagaaagtgcttctgtgaaagagtatgatttggaaaggggccatgatgagaaactggatgaaaatcagcattttggtttggaaagtgggcaccaacaccttccgtggaccaggaaagtctatgagttctacagtgctccaattgtcaagttttggttttatacgatggcgtatttggcattcctcatgctgttcacttacaccgtgttggtggagatgcagccccagcccagcgtgcaggagtggcttgttagcatttacatcttcaccaatgctattgaggtggtcagggagatctgtatttcagaacctgggaagtttacccaaaaggtgaaggtatggattagtgagtactggaacttaacagaaactgtggccattggcctgttttcagctggcttcgtccttcgatggggtgaccctccttttcacacagcgggaagactgatctactgcatagacatcatattctggttctcacggctcctggacttctttgctgtgaatcaacatgcaggtccatatgtgaccatgattgcaaaaatgacagcaaacatgttctatattgtgatcatcatggccatagtcctgctgagctttggagtggcacgcaaggccatcctttcgccaaaagagccaccatcttggagtctagctcgagatattgtatttgagccatactggatgatatacggagaagtctatgctggagaaatagatgtttgttcaagccagccatcctgccctcctggttcttttcttactccattcttgcaagctgtctacctcttcgtgcaatatatcatcatggtgaacctgttgattgctttcttcaacaacgtttacttagatatggaatccatttcaaataacctgtggaaatacaaccgctatcgctacatcatgacctaccacgagaagccctggctgcccccacctctcatcctgctgagccacgtgggccttctcctccgccgcctgtgctgtcatcgagctcctcacgaccaagaagagggtgacgttggattaaaactctacctcagtaaggaggatctgaaaaaacttcatgattttgaggagcagtgcgtggaaaaatacttccatgagaagatggaagatgtgaattgtagttgtgaggaacgaatccgagtgacatcagaaagggttacagagatgtacttccagctgaaagaaatgaatgaaaaggtgtcttttataaaggactccttactgtctttggacagccaggtgggacacctgcaggatctctctgccctgactgtggataccctgaaagtcctttctgctgttgacactttgcaagaggatgaggctctcctggccaagagaaagcattctacttgcaaaaaacttccccacagctggagcaatgtcatctgtgcagaggttctaggcagcatggagatcgctggagagaagaaataccagtattatagcatgccctcttctttgctgaggagcctggctggaggccggcatcccccaagagtgcagaggggggcacttcttgagattacaaacagtaaaagagaggctacaaatgtaagaaatgaccaggaaaggcaagaaacacaaagtagtatagtggtttctggggtgtctcctaacaggcaagcacactcaaagtatggccagtttcttctggtcccctctaatctaaagcgagttcctttttcagcagaaactgtcttgcctctgtccagaccctctgtgccagatgtgctggcaactgaacaggacatccagactgaggttcttgttcatctgactgggcagaccccagttgtctctgactgggcatcagtggatgaacccaaggaaaagcacgagcctattgctcacttactggatggacaagacaaggcagagcaagtgctacccactttgagttgcacacctgaacccatgacaatgagctcccctctccgcagatacaggcccttcgctaggagtcatagttttagattccataaggaggagaaattgatgaagatctgtaagattaaaagtaaggaataaacatttaaaatatcagcattaa

SEQ ID NO: 32186 - DNA, 1568 bp, Homo sapiens
actacaaaggatgtctgtgatgacagtggccatcccatttgatcctcgttattcttcttttatcgaaggaaactgagagtcaccttcttttctaggcagttaggtaactgaagccgaaaggtattgtgacagatccactgggctgtaaaaggcagcgtgtggaggtggagcccagagtttctgcctccacagttaaaagctcagacagggctttgggagcagggcctgcaaatcaaagatgaaagaacaacctgtcttggagcgcttgcagtcccagaaatcctggattaaaggagtatttgacaagagagaatgtagcacaatcatacccagctcaaaaaatcctcacagatgtactccagtatgccaagtctgccagaatttaatcaggtgttactgtggccgactgattggagaccatgctgggatagattattcctggaccatctcagctgccaagggtaaagaaagtgaacaatggtctgttgaaaagcacacaacgaaaagcccaacagatacttttggcacgattaatttccaagatggagagcacacccatcatgccaagtatattagaacttcttatgatacaaaactggatcatctgttacatttaatgttgaaagagtggaaaatggaactgcccaagcttgtgatctcagtccatgggggcatccagaactttactatgccctctaaatttaaagagattttcagccaaggtttggttaaagctgcagagacaacaggagcgtggataataactgaaggcatcaatacaggagtgtccaagcatgttggggatgccttgaaatcccattcctctcattccttgagaaaaatctggacagttggaatccctccttggggtgtcattgagaaccagagagaccttattggaaaagatgtggtgtgcctgtaccagactctggataaccccctcagcaagctcacaacactcaacagcatgcactcgcacttcatcctgtctgatgatgggaccgtgggcaagtatggaaatgaaatgaagctcagaaggaacctggagaagtacctctctctgcagaaaatacactgccgtgagtatcacaggggctcagtcacccagtctggttgcaggcctgctgaggtctttcatggtcttccctgaccatcagagctagcttgaggggactaggggtgtgagctttgatggtcagggaagatgacatttcatgtgttggtggggtggccctaggcagggaaggggttaagaccagacaggatttttagaaatagggaccttggggctgggtgtggtggctcacgcctgtaatcccagcactttgggaggctgaggcgggtggatcacctgaagtcaggagtcgagaccaacctggccaacatggtgaaaccctgtctctgctaaaaatacaaaaattagccaggtgtggtggtgcatgcctgtaatcccagctactcaggaggctgaggcaggagaatgacttgaacctggggtgtagaggttacagtgagctgagatcgccccactgcacttcagcccaggtgacagagcaagactctgtctc

SEQ ID NO: 32187 - DNA, 8425 bp, Homo sapiens
actacaaaggatgtctgtgatgacagtggccatcccatttgatcctcgttattcttcttttatcgaaggaaactgagagtcaccttcttttctaggcagttaggtaactgaagccgaaaggtattgtgacagatccactgggctgtaaaaggcagcgtgtggaggtggagcccagagtttctgcctccacagttaaaagctcagacagggctttgggagcagggcctgcaaatcaaagatgaaagaacaacctgtcttggagcgcttgcagtcccagaaatcctggattaaaggagtatttgacaagagagaatgtagcacaatcatacccagctcaaaaaatcctcacagatgtactccagtatgccaagtctgccagaatttaatcaggtgttactgtggccgactgattggagaccatgctgggatagattattcctggaccatctcagctgccaagggtaaagaaagtgaacaatggtctgttgaaaagcacacaacgaaaagcccaacagatacttttggcacgattaatttccaagatggagagcacacccatcatgccaagtatattagaacttcttatgatacaaaactggatcatctgttacatttaatgttgaaagagtggaaaatggaactgcccaagcttgtgatctcagtccatgggggcatccagaactttactatgccctctaaatttaaagagattttcagccaaggtttggttaaagctgcagagacaacaggagcgtggataataactgaaggcatcaatacaggagtgtccaagcatgttggggatgccttgaaatcccattcctctcattccttgagaaaaatctggacagttggaatccctccttggggtgtcattgagaaccagagagaccttattggaaaagatgtggtgtgcctgtaccagactctggataaccccctcagcaagctcacaacactcaacagcatgcactcgcacttcatcctgtctgatgatgggaccgtgggcaagtatggaaatgaaatgaagctcagaaggaacctggagaagtacctctctctgcagaaaatacactgccgctcaagacaaggcgtgccggtcgtggggctggtggtggaaggcggtcccaacgtcatcctgtcagtgtgggagactgtcaaggacaaggacccagtggtggtgtgtgagggcacaggtagggcggctgacctcctggccttcacacacaaacacctggcagatgaagggatgctgcgacctcaggtgaaagaggagatcatctgcatgattcagaacactttcaactttagtcttaaacagtccaagcaccttttccaaattctaatggagtgtatggttcacagggattgtattaccatatttgatgctgactctgaagagcagcaagacctggacttagcaatcctaacagctttgctgaagggcacaaatttatcagcgtcagagcaattaaatctggcaatggcttgggacagggtggacattgccaagaaacatatcctaatttatgaacaacactggaagcctgatgccctggaacaagcaatgtcagatgctttagtgatggatcgggtggattttgtgaagctcttaatagaatatggagtgaacctccatcgctttcttaccatccctcgactggaagagctctacaatacaaaacaaggacctactaatacactcttgcatcatctcgtccaagatgtgaaacagcatacccttctttcaggctaccgaataaccttgattgacattggattagtagtagaatacctcattggtagagcatatcgcagcaactacactagaaaacatttcagagccctctacaacaacctctacagaaaatacaagcaccagagacactcctcaggaaatagaaatgagtctgcagaaagtacgctgcactcccagttcattagaactgcacagccatacaaattcaaggaaaagtctatagtccttcataaatcaaggaagaagtcaaaagaacaaaatgtatcagatgaccctgagtctactggctttctttacccttacaatgacctgctggtttgggctgtgctgatgaaaaggcagaagatggctatgttcttctggcagcatggagaggaggccacggttaaagccgtgattgcgtgtatcctctaccgggcaatggcccatgaagctaaggagagtcacatggtggatgatgcctcagaagagttgaagaattactcaaaacagtttggccagctggctctggacttgttggagaaggcattcaagcagaatgagcgcatggccatgacgctgttgacgtatgaactcaggaactggagcaattcgacctgccttaaactggccgtgtcgggaggattacgaccctttgtttcacatacttgtacccagatgctactgacagacatgtggatggggaggctgaaaatgaggaaaaactcttggttaaagattattataagcattattttaccacccaccattttgacactggaatttaaaagcaaagctgagatgtcacatgttccccagtcccaggacttccaatttatgtggtattacagtgaccagaacgccagcagttccaaagaaagtgcttctgtgaaagagtatgatttggaaaggggccatgatgagaaactggatgaaaatcagcattttggtttggaaagtgggcaccaacaccttccgtggaccaggaaagtctatgagttctacagtgctccaattgtcaagttttggttttatacgatggcgtatttggcattcctcatgctgttcacttacaccgtgttggtggagatgcagccccagcccagcgtgcaggagtggcttgttagcatttacatcttcaccaatgctattgaggtggtcagggagatctgtatttcagaacctgggaagtttacccaaaaggtgaaggtatggattagtgagtactggaacttaacagaaactgtggccattggcctgttttcagctggcttcgtccttcgatggggtgaccctccttttcacacagcgggaagactgatctactgcatagacatcatattctggttctcacggctcctggacttctttgctgtgaatcaacatgcaggtccatatgtgaccatgattgcaaaaatgacagcaaacatgttctatattgtgatcatcatggccatagtcctgctgagctttggagtggcacgcaaggccatcctttcgccaaaagagccaccatcttggagtctagctcgagatattgtatttgagccatactggatgatatacggagaagtctatgctggagaaatagatgtttgttcaagccagccatcctgccctcctggttcttttcttactccattcttgcaagctgtctacctcttcgtgcaatatatcatcatggtgaacctgttgattgctttcttcaacaacgtttacttagatatggaatccatttcaaataacctgtggaaatacaaccgctatcgctacatcatgacctaccacgagaagccctggctgcccccacctctcatcctgctgagccacgtgggccttctcctccgccgcctgtgctgtcatcgagctcctcacgaccaagaagagggtgacgttggattaaaactctacctcagtaaggaggatctgaaaaaacttcatgattttgaggagcagtgcgtggaaaaatacttccatgagaagatggaagatgtgaattgtagttgtgaggaacgaatccgagtgacatcagaaagggttacagagatgtacttccagctgaaagaaatgaatgaaaaggtgtcttttataaaggactccttactgtctttggacagccaggtgggacacctgcaggatctctctgccctgactgtggataccctgaaagtcctttctgctgttgacactttgcaagaggatgaggctctcctggccaagagaaagcattctacttgcaaaaaacttccccacagctggagcaatgtcatctgtgcagaggttctaggcagcatggagatcgctggagagaagaaataccagtattatagcatgccctcttctttgctgaggagcctggctggaggccggcatcccccaagagtgcagaggggggcacttcttgagattacaaacagtaaaagagaggctacaaatgtaagaaatgaccaggaaaggcaagaaacacaaagtagtatagtggtttctggggtgtctcctaacaggcaagcacactcaaagtatggccagtttcttctggtcccctctaatctaaagcgagttcctttttcagcagaaactgtcttgcctctgtccagaccctctgtgccagatgtgctggcaactgaacaggacatccagactgaggttcttgttcatctgactgggcagaccccagttgtctctgactgggcatcagtggatgaacccaaggaaaagcacgagcctattgctcacttactggatggacaagacaaggcagagcaagtgctacccactttgagttgcacacctgaacccatgacaatgagctcccctctttcccaagccaagatcatgcaaactggaggtggatatgtaaactgggcattttcagaaggtgatgaaactggtgtgtttagcatcaagaaaaagtggcaaacctgcttgccctccacttgtgacagtgattcctctcggagtgaacagcaccagaagcaggcccaggacagctccctatctgataactcaacaagatcggcccagagtagtgaatgctcagaggtgggaccatggcttcagccaaacacatccttttggatcaatcctctccgcagatacaggcccttcgctaggagtcatagttttagattccataaggaggagaaattgatgaagatctgtaagattaaaaatctttcaggctcttcagaaatagggcagggagcatgggtcaaagcgaaaatgctaaccaaagacaggagactgtcaaagaaaaagaagaatactcaaggactccaggtgccaatcataacagtcaatgcctgctctcagagtgaccagttgaatccagagccaggagaaaacagcatctctgaagaggagtacagcaagaactggttcacagtgtccaaatttagtcacacaggtgtagaaccttacatacatcagaaaatgaaaactaaagaaattggacaatgtgctatacaaatcagtgattacctaaagcagtctcaagaggatctcagcaaaaactctttgtggaattccaggagcaccaacctcaataggaactccctgctgaaaagttcaattggagttgacaagatctcagcctccttaaaaagccctcaagagcctcaccatcattattcagccattgaaaggaataatttaatgaggctttctcagaccataccatttacaccagtccaactgtttgcaggagaagaaataactgtctacaggttggaggagagttcccctttaaaccttgataaaagcatgtcctcttggtctcagcgtgggagagcggcaatgatccaggtattgtcccgagaggagatggatgggggcctccgtaaagctatgagagtcgtcagcacttggtctgaggatgacattctcaagccgggacaagttttcattgtcaagtcctttcttcctgaggttgtgcggacatggcataaaatcttccaggagagcactgtgcttcatctttgcctcagggaaattcaacaacaaagagctgctcaaaaattgatctataccttcaaccaagtgaaaccacaaaccataccctacacaccaaggttcctggaagttttcttaatctactgccattcagccaaccagtggttgaccattgagaagtatatgacaggggagttccggaagtataacaacaacaatggtgatgaaatcacccccaccaacaccctggaggagctgatgttggctttctctcactggacctatgagtacactcggggagagctgctggttttagatttgcaaggtgttggagaaaatttgacagatccatctgttataaaacctgaagtcaaacaatcaagaggaatggtgtttggaccggccaatttgggggaagatgcaattagaaacttcattgcaaaacatcattgtaactcctgctgccggaagctcaaactcccggatttaaaaagaaatgactattcccctgaaaggataaattccacctttggacttgagataaaaatagaatcagctgaggagcctccagcaagggagacgggtagaaattccccagaagatgatatgcaactataaaaagggaggagcaagaagatcccagtgcttgccctgcctgccaggaactctgtgataacatagattgatcaacgtgatgttgattacatcagcgtctccttgggacacgccttctgagcctcacatctccttctgttcaaaggcctcattggtatatgatcaatgggttctcctagacactgacctctgtccagggcactttgcagctccatcctcaagttccacacgaagatgcttggatgagtcagctgggaatattgttcttgtgtacctcattgctttagctggtcacttggaactttggagcagaatcctgcacattaaaggatggggttgggggggatacatttattttattttctcactatgtatgcagactggaccccctactactatttgtcacctcacccacagattgtatttatgtctatatatatgttcataaaaagttatgtgatttcctcctctgtcttttccacaacataggactttgaatagcaatgataggaaaaacaatggaacaagggtgggtttgcacagattggagcacattcctgcacaaactaccaagtatactggtgaaatctcgatgggtttcagatattgtcagtgaatcatatgatgcctggatatttcaggtttctgtaaaagaaagggaaacctaaaacaaatacccttccatatataatatatatggaatatgtatattatatatatttttatatatataatatatatggaatatatatattatatatataaaatacatatggaatatatatattttatatatatatatatatatttttatttttgagatggagtttcactctttttacccaggctggagtgcaatgatgcgatctcactgcaacctctgcctcccgggcttgagcgattcttgtgtctcagtcttccgggtagctgggactacaggtgtgcaccactatgcctggctaattttgtatttttagtagagatggggtttcaccatgttggccaggctggtctcaaactcctgacctcagatgatccacctgccttggcttcccaaagtgctgggattacaggcgtgagccactgcgcctggcctttttttttttttttttaaacgagaacaagaatatgaagaactggaaatcattaagaaagggtttcccttccttaaagctcaggggtactattagttaggagttgactaactcaacctgtaaaacaccactcctccttccaaagttgtatatataatattgcaggttaaattactttatgtcaggtcctatgaagaaagatacggtttcagactgaaaacatgtttcacaggtgtttgcttccttccagagcagagttccctattcccctggcataaagaatgtatatatattttgaaatatggctgagaacatgtcattggtttgtgaggcctaaggtgaagcactcctggcagccacactgtgtagtgtatttgagggatcagtcatccctcttgtatgctgggcctggttgccctacctcgaacaagcaccagcttttcacacaaggagagatgtggggctgggagtcctctccccatcctattgcatctcctttcttattataagctgttccagttcacaggcagcaaacctcctgggtttgaaaaattccaacttatttttatctttaatcctgacattagctgacttgctagtgagcttgctttaaaaatctacactcttgcattcttaggcatacaggggaaatgttgaaaaggaaggtggaaaaccaagaatttagtttgccaatgattgcctctgattcttgtaagtttgagttccacaagggctaatttattccccttttacttgggttttggggtggtggaaagcgggaaatttgggtgatttgttgattggcaatgaggataaaatgttaatacttttttggggacttaacaactttatcctattctacaagtcagtaaaggaacaattggtactcacctcagtgctgcactcaactatggaaagaggcagagtttgcttgcccaattgccaaactaaagacatcagttcattggtcaaatatttgttacctggaatggaacttgaaagcaaatacatttggatttcaaatttc

SEQ ID NO: 32188 - DNA, 8271 bp, Homo sapiens
gctttccgaggcggctggagaagtgcccagacggccgtccctccgcgcccctgcgcgtccccgtgcgcccagtgttccccgtgcaggagtcccggagcgatgacagcgccggttacgtcccagaaatcctggattaaaggagtatttgacaagagagaatgtagcacaatcatacccagctcaaaaaatcctcacagatgtactccagtatgccaagtctgccagaatttaatcaggtgttactgtggccgactgattggagaccatgctgggatagattattcctggaccatctcagctgccaagggtaaagaaagtgaacaatggtctgttgaaaagcacacaacgaaaagcccaacagatacttttggcacgattaatttccaagatggagagcacacccatcatgccaagtatattagaacttcttatgatacaaaactggatcatctgttacatttaatgttgaaagagtggaaaatggaactgcccaagcttgtgatctcagtccatgggggcatccagaactttactatgccctctaaatttaaagagattttcagccaaggtttggttaaagctgcagagacaacaggagcgtggataataactgaaggcatcaatacaggagtgtccaagcatgttggggatgccttgaaatcccattcctctcattccttgagaaaaatctggacagttggaatccctccttggggtgtcattgagaaccagagagaccttattggaaaagatgtggtgtgcctgtaccagactctggataaccccctcagcaagctcacaacactcaacagcatgcactcgcacttcatcctgtctgatgatgggaccgtgggcaagtatggaaatgaaatgaagctcagaaggaacctggagaagtacctctctctgcagaaaatacactgccgctcaagacaaggcgtgccggtcgtggggctggtggtggaaggcggtcccaacgtcatcctgtcagtgtgggagactgtcaaggacaaggacccagtggtggtgtgtgagggcacaggtagggcggctgacctcctggccttcacacacaaacacctggcagatgaagggatgctgcgacctcaggtgaaagaggagatcatctgcatgattcagaacactttcaactttagtcttaaacagtccaagcaccttttccaaattctaatggagtgtatggttcacagggattgtattaccatatttgatgctgactctgaagagcagcaagacctggacttagcaatcctaacagctttgctgaagggcacaaatttatcagcgtcagagcaattaaatctggcaatggcttgggacagggtggacattgccaagaaacatatcctaatttatgaacaacactggaagcctgatgccctggaacaagcaatgtcagatgctttagtgatggatcgggtggattttgtgaagctcttaatagaatatggagtgaacctccatcgctttcttaccatccctcgactggaagagctctacaatacaaaacaaggacctactaatacactcttgcatcatctcgtccaagatgtgaaacagcatacccttctttcaggctaccgaataaccttgattgacattggattagtagtagaatacctcattggtagagcatatcgcagcaactacactagaaaacatttcagagccctctacaacaacctctacagaaaatacaagcaccagagacactcctcaggaaatagaaatgagtctgcagaaagtacgctgcactcccagttcattagaactgcacagccatacaaattcaaggaaaagtctatagtccttcataaatcaaggaagaagtcaaaagaacaaaatgtatcagatgaccctgagtctactggctttctttacccttacaatgacctgctggtttgggctgtgctgatgaaaaggcagaagatggctatgttcttctggcagcatggagaggaggccacggttaaagccgtgattgcgtgtatcctctaccgggcaatggcccatgaagctaaggagagtcacatggtggatgatgcctcagaagagttgaagaattactcaaaacagtttggccagctggctctggacttgttggagaaggcattcaagcagaatgagcgcatggccatgacgctgttgacgtatgaactcaggaactggagcaattcgacctgccttaaactggccgtgtcgggaggattacgaccctttgtttcacatacttgtacccagatgctactgacagacatgtggatggggaggctgaaaatgaggaaaaactcttggttaaagattattataagcattattttaccacccaccattttgacactggaatttaaaagcaaagctgagatgtcacatgttccccagtcccaggacttccaatttatgtggtattacagtgaccagaacgccagcagttccaaagaaagtgcttctgtgaaagagtatgatttggaaaggggccatgatgagaaactggatgaaaatcagcattttggtttggaaagtgggcaccaacaccttccgtggaccaggaaagtctatgagttctacagtgctccaattgtcaagttttggttttatacgatggcgtatttggcattcctcatgctgttcacttacaccgtgttggtggagatgcagccccagcccagcgtgcaggagtggcttgttagcatttacatcttcaccaatgctattgaggtggtcagggagatctgtatttcagaacctgggaagtttacccaaaaggtgaaggtatggattagtgagtactggaacttaacagaaactgtggccattggcctgttttcagctggcttcgtccttcgatggggtgaccctccttttcacacagcgggaagactgatctactgcatagacatcatattctggttctcacggctcctggacttctttgctgtgaatcaacatgcaggtccatatgtgaccatgattgcaaaaatgacagcaaacatgttctatattgtgatcatcatggccatagtcctgctgagctttggagtggcacgcaaggccatcctttcgccaaaagagccaccatcttggagtctagctcgagatattgtatttgagccatactggatgatatacggagaagtctatgctggagaaatagatgtttgttcaagccagccatcctgccctcctggttcttttcttactccattcttgcaagctgtctacctcttcgtgcaatatatcatcatggtgaacctgttgattgctttcttcaacaacgtttacttagatatggaatccatttcaaataacctgtggaaatacaaccgctatcgctacatcatgacctaccacgagaagccctggctgcccccacctctcatcctgctgagccacgtgggccttctcctccgccgcctgtgctgtcatcgagctcctcacgaccaagaagagggtgacgttggattaaaactctacctcagtaaggaggatctgaaaaaacttcatgattttgaggagcagtgcgtggaaaaatacttccatgagaagatggaagatgtgaattgtagttgtgaggaacgaatccgagtgacatcagaaagggttacagagatgtacttccagctgaaagaaatgaatgaaaaggtgtcttttataaaggactccttactgtctttggacagccaggtgggacacctgcaggatctctctgccctgactgtggataccctgaaagtcctttctgctgttgacactttgcaagaggatgaggctctcctggccaagagaaagcattctacttgcaaaaaacttccccacagctggagcaatgtcatctgtgcagaggttctaggcagcatggagatcgctggagagaagaaataccagtattatagcatgccctcttctttgctgaggagcctggctggaggccggcatcccccaagagtgcagaggggggcacttcttgagattacaaacagtaaaagagaggctacaaatgtaagaaatgaccaggaaaggcaagaaacacaaagtagtatagtggtttctggggtgtctcctaacaggcaagcacactcaaagtatggccagtttcttctggtcccctctaatctaaagcgagttcctttttcagcagaaactgtcttgcctctgtccagaccctctgtgccagatgtgctggcaactgaacaggacatccagactgaggttcttgttcatctgactgggcagaccccagttgtctctgactgggcatcagtggatgaacccaaggaaaagcacgagcctattgctcacttactggatggacaagacaaggcagagcaagtgctacccactttgagttgcacacctgaacccatgacaatgagctcccctctttcccaagccaagatcatgcaaactggaggtggatatgtaaactgggcattttcagaaggtgatgaaactggtgtgtttagcatcaagaaaaagtggcaaacctgcttgccctccacttgtgacagtgattcctctcggagtgaacagcaccagaagcaggcccaggacagctccctatctgataactcaacaagatcggcccagagtagtgaatgctcagaggtgggaccatggcttcagccaaacacatccttttggatcaatcctctccgcagatacaggcccttcgctaggagtcatagttttagattccataaggaggagaaattgatgaagatctgtaagattaaaaatctttcaggctcttcagaaatagggcagggagcatgggtcaaagcgaaaatgctaaccaaagacaggagactgtcaaagaaaaagaagaatactcaaggactccaggtgccaatcataacagtcaatgcctgctctcagagtgaccagttgaatccagagccaggagaaaacagcatctctgaagaggagtacagcaagaactggttcacagtgtccaaatttagtcacacaggtgtagaaccttacatacatcagaaaatgaaaactaaagaaattggacaatgtgctatacaaatcagtgattacctaaagcagtctcaagaggatctcagcaaaaactctttgtggaattccaggagcaccaacctcaataggaactccctgctgaaaagttcaattggagttgacaagatctcagcctccttaaaaagccctcaagagcctcaccatcattattcagccattgaaaggaataatttaatgaggctttctcagaccataccatttacaccagtccaactgtttgcaggagaagaaataactgtctacaggttggaggagagttcccctttaaaccttgataaaagcatgtcctcttggtctcagcgtgggagagcggcaatgatccaggtattgtcccgagaggagatggatgggggcctccgtaaagctatgagagtcgtcagcacttggtctgaggatgacattctcaagccgggacaagttttcattgtcaagtcctttcttcctgaggttgtgcggacatggcataaaatcttccaggagagcactgtgcttcatctttgcctcagggaaattcaacaacaaagagctgctcaaaaattgatctataccttcaaccaagtgaaaccacaaaccataccctacacaccaaggttcctggaagttttcttaatctactgccattcagccaaccagtggttgaccattgagaagtatatgacaggggagttccggaagtataacaacaacaatggtgatgaaatcacccccaccaacaccctggaggagctgatgttggctttctctcactggacctatgagtacactcggggagagctgctggttttagatttgcaaggtgttggagaaaatttgacagatccatctgttataaaacctgaagtcaaacaatcaagaggaatggtgtttggaccggccaatttgggggaagatgcaattagaaacttcattgcaaaacatcattgtaactcctgctgccggaagctcaaactcccggatttaaaaagaaatgactattcccctgaaaggataaattccacctttggacttgagataaaaatagaatcagctgaggagcctccagcaagggagacgggtagaaattccccagaagatgatatgcaactataaaaagggaggagcaagaagatcccagtgcttgccctgcctgccaggaactctgtgataacatagattgatcaacgtgatgttgattacatcagcgtctccttgggacacgccttctgagcctcacatctccttctgttcaaaggcctcattggtatatgatcaatgggttctcctagacactgacctctgtccagggcactttgcagctccatcctcaagttccacacgaagatgcttggatgagtcagctgggaatattgttcttgtgtacctcattgctttagctggtcacttggaactttggagcagaatcctgcacattaaaggatggggttgggggggatacatttattttattttctcactatgtatgcagactggaccccctactactatttgtcacctcacccacagattgtatttatgtctatatatatgttcataaaaagttatgtgatttcctcctctgtcttttccacaacataggactttgaatagcaatgataggaaaaacaatggaacaagggtgggtttgcacagattggagcacattcctgcacaaactaccaagtatactggtgaaatctcgatgggtttcagatattgtcagtgaatcatatgatgcctggatatttcaggtttctgtaaaagaaagggaaacctaaaacaaatacccttccatatataatatatatggaatatgtatattatatatatttttatatatataatatatatggaatatatatattatatatataaaatacatatggaatatatatattttatatatatatatatatatttttatttttgagatggagtttcactctttttacccaggctggagtgcaatgatgcgatctcactgcaacctctgcctcccgggcttgagcgattcttgtgtctcagtcttccgggtagctgggactacaggtgtgcaccactatgcctggctaattttgtatttttagtagagatggggtttcaccatgttggccaggctggtctcaaactcctgacctcagatgatccacctgccttggcttcccaaagtgctgggattacaggcgtgagccactgcgcctggcctttttttttttttttttaaacgagaacaagaatatgaagaactggaaatcattaagaaagggtttcccttccttaaagctcaggggtactattagttaggagttgactaactcaacctgtaaaacaccactcctccttccaaagttgtatatataatattgcaggttaaattactttatgtcaggtcctatgaagaaagatacggtttcagactgaaaacatgtttcacaggtgtttgcttccttccagagcagagttccctattcccctggcataaagaatgtatatatattttgaaatatggctgagaacatgtcattggtttgtgaggcctaaggtgaagcactcctggcagccacactgtgtagtgtatttgagggatcagtcatccctcttgtatgctgggcctggttgccctacctcgaacaagcaccagcttttcacacaaggagagatgtggggctgggagtcctctccccatcctattgcatctcctttcttattataagctgttccagttcacaggcagcaaacctcctgggtttgaaaaattccaacttatttttatctttaatcctgacattagctgacttgctagtgagcttgctttaaaaatctacactcttgcattcttaggcatacaggggaaatgttgaaaaggaaggtggaaaaccaagaatttagtttgccaatgattgcctctgattcttgtaagtttgagttccacaagggctaatttattccccttttacttgggttttggggtggtggaaagcgggaaatttgggtgatttgttgattggcaatgaggataaaatgttaatacttttttggggacttaacaactttatcctattctacaagtcagtaaaggaacaattggtactcacctcagtgctgcactcaactatggaaagaggcagagtttgcttgcccaattgccaaactaaagacatcagttcattggtcaaatatttgttacctggaatggaacttgaaagcaaatacatttggatttcaaatttc

SEQ ID NO: 32189 - DNA, 6082 bp, Homo sapiens
actacaaaggatgtctgtgatgacagtggccatcccatttgatcctcgttattcttcttttatcgaaggaaactgagagtcaccttcttttctaggcagttaggtaactgaagccgaaaggtattgtgacagatccactgggctgtaaaaggcagcgtgtggaggtggagcccagagtttctgcctccacagttaaaagctcagacagggctttgggagcagggcctgcaaatcaaagatgaaagaacaacctgtcttggagcgcttgcagtcccagaaatcctggattaaaggagtatttgacaagagagaatgtagcacaatcatacccagctcaaaaaatcctcacagatgtactccagtatgccaagtctgccagaatttaatcaggtgttactgtggccgactgattggagaccatgctgggatagattattcctggaccatctcagctgccaagggtaaagaaagtgaacaatggtctgttgaaaagcacacaacgaaaagcccaacagatacttttggcacgattaatttccaagatggagagcacacccatcatgccaagtatattagaacttcttatgatacaaaactggatcatctgttacatttaatgttgaaagagtggaaaatggaactgcccaagcttgtgatctcagtccatgggggcatccagaactttactatgccctctaaatttaaagagattttcagccaaggtttggttaaagctgcagagacaacaggagcgtggataataactgaaggcatcaatacaggagtgtccaagcatgttggggatgccttgaaatcccattcctctcattccttgagaaaaatctggacagttggaatccctccttggggtgtcattgagaaccagagagaccttattggaaaagatgtggtgtgcctgtaccagactctggataaccccctcagcaagctcacaacactcaacagcatgcactcgcacttcatcctgtctgatgatgggaccgtgggcaagtatggaaatgaaatgaagctcagaaggaacctggagaagtacctctctctgcagaaaatacactgccgctcaagacaaggcgtgccggtcgtggggctggtggtggaaggcggtcccaacgtcatcctgtcagtgtgggagactgtcaaggacaaggacccagtggtggtgtgtgagggcacaggtagggcggctgacctcctggccttcacacacaaacacctggcagatgaagggatgctgcgacctcaggtgaaagaggagatcatctgcatgattcagaacactttcaactttagtcttaaacagtccaagcaccttttccaaattctaatggagtgtatggttcacagggattgtattaccatatttgatgctgactctgaagagcagcaagacctggacttagcaatcctaacagctttgctgaagggcacaaatttatcagcgtcagagcaattaaatctggcaatggcttgggacagggtggacattgccaagaaacatatcctaatttatgaacaacactggaagcctgatgccctggaacaagcaatgtcagatgctttagtgatggatcgggtggattttgtgaagctcttaatagaatatggagtgaacctccatcgctttcttaccatccctcgactggaagagctctacaatacaaaacaaggacctactaatacactcttgcatcatctcgtccaagatgtgaaacagcatacccttctttcaggctaccgaataaccttgattgacattggattagtagtagaatacctcattggtagagcatatcgcagcaactacactagaaaacatttcagagccctctacaacaacctctacagaaaatacaagcaccagagacactcctcaggaaatagaaatgagtctgcagaaagtacgctgcactcccagttcattagaactgcacagccatacaaattcaaggaaaagtctatagtccttcataaatcaaggaagaagtcaaaagaacaaaatgtatcagatgaccctgagtctactggctttctttacccttacaatgacctgctggtttgggctgtgctgatgaaaaggcagaagatggctatgttcttctggcagcatggagaggaggccacggttaaagccgtgattgcgtgtatcctctaccgggcaatggcccatgaagctaaggagagtcacatggtggatgatgcctcagaagagttgaagaattactcaaaacagtttggccagctggctctggacttgttggagaaggcattcaagcagaatgagcgcatggccatgacgctgttgacgtatgaactcaggaactggagcaattcgacctgccttaaactggccgtgtcgggaggattacgaccctttgtttcacatacttgtacccagatgctactgacagacatgtggatggggaggctgaaaatgaggaaaaactcttggttaaagattattataagcattattttaccacccaccattttgacactggaatttaaaagcaaagctgagatgtcacatgttccccagtcccaggacttccaatttatgtggtattacagtgaccagaacgccagcagttccaaagaaagtgcttctgtgaaagagtatgatttggaaaggggccatgatgagaaactggatgaaaatcagcattttggtttggaaagtgggcaccaacaccttccgtggaccaggaaagtctatgagttctacagtgctccaattgtcaagttttggttttatacgatggcgtatttggcattcctcatgctgttcacttacaccgtgttggtggagatgcagccccagcccagcgtgcaggagtggcttgttagcatttacatcttcaccaatgctattgaggtggtcagggagatctgtatttcagaacctgggaagtttacccaaaaggtgaaggtatggattagtgagtactggaacttaacagaaactgtggccattggcctgttttcagctggcttcgtccttcgatggggtgaccctccttttcacacagcgggaagactgatctactgcatagacatcatattctggttctcacggctcctggacttctttgctgtgaatcaacatgcaggtccatatgtgaccatgattgcaaaaatgacagcaaacatgttctatattgtgatcatcatggccatagtcctgctgagctttggagtggcacgcaaggccatcctttcgccaaaagagccaccatcttggagtctagctcgagatattgtatttgagccatactggatgatatacggagaagtctatgctggagaaatagatgtttgttcaagccagccatcctgccctcctggttcttttcttactccattcttgcaagctgtctacctcttcgtgcaatatatcatcatggtgaacctgttgattgctttcttcaacaacgtttacttagatatggaatccatttcaaataacctgtggaaatacaaccgctatcgctacatcatgacctaccacgagaagccctggctgcccccacctctcatcctgctgagccacgtgggccttctcctccgccgcctgtgctgtcatcgagctcctcacgaccaagaagagggtgacgttggattaaaactctacctcagtaaggaggatctgaaaaaacttcatgattttgaggagcagtgcgtggaaaaatacttccatgagaagatggaagatgtgaattgtagttgtgaggaacgaatccgagtgacatcagaaagggttacagagatgtacttccagctgaaagaaatgaatgaaaaggtgtcttttataaaggactccttactgtctttggacagccaggtgggacacctgcaggatctctctgccctgactgtggataccctgaaagtcctttctgctgttgacactttgcaagaggatgaggctctcctggccaagagaaagcattctacttgcaaaaaacttccccacagctggagcaatgtcatctgtgcagaggttctaggcagcatggagatcgctggagagaagaaataccagtattatagcatgccctcttctttgctgaggagcctggctggaggccggcatcccccaagagtgcagaggggggcacttcttgagattacaaacagtaaaagagaggctacaaatgtaagaaatgaccaggaaaggcaagaaacacaaagtagtatagtggtttctggggtgtctcctaacaggcaagcacactcaaagtatggccagtttcttctggtcccctctaatctaaagcgagttcctttttcagcagaaactgtcttgcctctgtccagaccctctgtgccagatgtgctggcaactgaacaggacatccagactgaggttcttgttcatctgactgggcagaccccagttgtctctgactgggcatcagtggatgaacccaaggaaaagcacgagcctattgctcacttactggatggacaagacaaggcagagcaagtgctacccactttgagttgcacacctgaacccatgacaatgagctcccctctttcccaagccaagatcatgcaaactggaggtggatatgtaaactgggcattttcagaaggtgatgaaactggtgtgtttagcatcaagaaaaagtggcaaacctgcttgccctccacttgtgacagtgattcctctcggagtgaacagcaccagaagcaggcccaggacagctccctatctgataactcaacaagatcggcccagagtagtgaatgctcagaggtgggaccatggcttcagccaaacacatccttttggatcaatcctctccgcagatacaggcccttcgctaggagtcatagttttagattccataaggaggagaaattgatgaagatctgtaagattaaaaatctttcaggctcttcagaaatagggcagggagcatgggtcaaagcgaaaatgctaaccaaagacaggagactgtcaaagaaaaagaagaatactcaaggactccaggtgccaatcataacagtcaatgcctgctctcagagtgaccagttgaatccagagccaggagaaaacagcatctctgaagaggagtacagcaagaactggttcacagtgtccaaatttagtcacacaggtgtagaaccttacatacatcagaaaatgaaaactaaagaaattggacaatgtgctatacaaatcagtgattacctaaagcagtctcaagaggatctcagcaaaaactctttgtggaattccaggagcaccaacctcaataggaactccctccatgtaattaaaatgccaatctcctctctaatttcagagatctcagcctccttaaaaagccctcaagagcctcaccatcattattcagccattgaaaggaataatttaatgaggctttctcagaccataccatttacaccagtccaactgtttgcaggagaagaaataactgtctacaggttggaggagagttcccctttaaaccttgataaaagcatgtcctcttggtctcagcgtgggagagcggcaatgatccaggtattgtcccgagaggagatggatgggggcctccgtaaagctatgagagtcgtcagcacttggtctgaggatgacattctcaagccgggacaagttttcattgtcaagtcctttcttcctgaggttgtgcggacatggcataaaatcttccaggagagcactgtgcttcatctttgcctcagggaaattcaacaacaaagagctgctcaaaaattgatctataccttcaaccaagtgaaaccacaaaccataccctacacaccaaggttcctggaagttttcttaatctactgccattcagccaaccagtggttgaccattgagaagtatatgacaggggagttccggaagtataacaacaacaatggtgatgaaatcacccccaccaacaccctggaggagctgatgttggctttctctcactggacctatgagtacactcggggagagctgctggttttagatttgcaagctctctggttctgggattctatgctgaaagccaggcttggaggttggagaatgtag

SEQ ID NO: 32190 - DNA, 3825 bp, Homo sapiens
cgtgagtcaccacacccagccctccttcaatcccagaaatcctggattaaaggagtatttgacaagagagaatgtagcacaatcatacccagctcaaaaaatcctcacagatgtactccagtatgccaagtctgccagaatttaatcaggtgttactgtggccgactgattggagaccatgctgggatagattattcctggaccatctcagctgccaagggtaaagaaagtgaacaatggtctgttgaaaagcacacaacgaaaagcccaacagatacttttggcacgattaatttccaagatggagagcacacccatcatgccaagtatattagaacttcttatgatacaaaactggatcatctgttacatttaatgttgaaagagtggaaaatggaactgcccaagcttgtgatctcagtccatgggggcatccagaactttactatgccctctaaatttaaagagattttcagccaaggtttggttaaagctgcagagacaacaggagcgtggataataactgaaggcatcaatacaggagtgtccaagcatgttggggatgccttgaaatcccattcctctcattccttgagaaaaatctggacagttggaatccctccttggggtgtcattgagaaccagagagaccttattggaaaagatgtggtgtgcctgtaccagactctggataaccccctcagcaagctcacaacactcaacagcatgcactcgcacttcatcctgtctgatgatgggaccgtgggcaagtatggaaatgaaatgaagctcagaaggaacctggagaagtacctctctctgcagaaaatacactgcccaggagaagaaataactgtctacaggttggaggagagttcccctttaaaccttgataaaagcatgtcctcttggtctcagcgtgggagagcggcaatgatccaggtattgtcccgagaggagatggatgggggcctccgtaaagctatgagagtcgtcagcacttggtctgaggatgacattctcaagccgggacaagttttcattgtcaagtcctttcttcctgaggttgtgcggacatggcataaaatcttccaggagagcactgtgcttcatctttgcctcagggaaattcaacaacaaagagctgctcaaaaattgatctataccttcaaccaagtgaaaccacaaaccataccctacacaccaaggttcctggaagttttcttaatctactgccattcagccaaccagtggttgaccattgagaagtatatgacaggggagttccggaagtataacaacaacaatggtgatgaaatcacccccaccaacaccctggaggagctgatgttggctttctctcactggacctatgagtacactcggggagagctgctggttttagatttgcaaggtgttggagaaaatttgacagatccatctgttataaaacctgaagtcaaacaatcaagaggaatggtgtttggaccggccaatttgggggaagatgcaattagaaacttcattgcaaaacatcattgtaactcctgctgccggaagctcaaactcccggatttaaaaagaaatgactattcccctgaaaggataaattccacctttggacttgagataaaaatagaatcagctgaggagcctccagcaagggagacgggtagaaattccccagaagatgatatgcaactataaaaagggaggagcaagaagatcccagtgcttgccctgcctgccaggaactctgtgataacatagattgatcaacgtgatgttgattacatcagcgtctccttgggacacgccttctgagcctcacatctccttctgttcaaaggcctcattggtatatgatcaatgggttctcctagacactgacctctgtccagggcactttgcagctccatcctcaagttccacacgaagatgcttggatgagtcagctgggaatattgttcttgtgtacctcattgctttagctggtcacttggaactttggagcagaatcctgcacattaaaggatggggttgggggggatacatttattttattttctcactatgtatgcagactggaccccctactactatttgtcacctcacccacagattgtatttatgtctatatatatgttcataaaaagttatgtgatttcctcctctgtcttttccacaacataggactttgaatagcaatgataggaaaaacaatggaacaagggtgggtttgcacagattggagcacattcctgcacaaactaccaagtatactggtgaaatctcgatgggtttcagatattgtcagtgaatcatatgatgcctggatatttcaggtttctgtaaaagaaagggaaacctaaaacaaatacccttccatatataatatatatggaatatgtatattatatatatttttatatatataatatatatggaatatatatattatatatataaaatacatatggaatatatatattttatatatatatatatatatttttatttttgagatggagtttcactctttttacccaggctggagtgcaatgatgcgatctcactgcaacctctgcctcccgggcttgagcgattcttgtgtctcagtcttccgggtagctgggactacaggtgtgcaccactatgcctggctaattttgtatttttagtagagatggggtttcaccatgttggccaggctggtctcaaactcctgacctcagatgatccacctgccttggcttcccaaagtgctgggattacaggcgtgagccactgcgcctggcctttttttttttttttttaaacgagaacaagaatatgaagaactggaaatcattaagaaagggtttcccttccttaaagctcaggggtactattagttaggagttgactaactcaacctgtaaaacaccactcctccttccaaagttgtatatataatattgcaggttaaattactttatgtcaggtcctatgaagaaagatacggtttcagactgaaaacatgtttcacaggtgtttgcttccttccagagcagagttccctattcccctggcataaagaatgtatatatattttgaaatatggctgagaacatgtcattggtttgtgaggcctaaggtgaagcactcctggcagccacactgtgtagtgtatttgagggatcagtcatccctcttgtatgctgggcctggttgccctacctcgaacaagcaccagcttttcacacaaggagagatgtggggctgggagtcctctccccatcctattgcatctcctttcttattataagctgttccagttcacaggcagcaaacctcctgggtttgaaaaattccaacttatttttatctttaatcctgacattagctgacttgctagtgagcttgctttaaaaatctacactcttgcattcttaggcatacaggggaaatgttgaaaaggaaggtggaaaaccaagaatttagtttgccaatgattgcctctgattcttgtaagtttgagttccacaagggctaatttattccccttttacttgggttttggggtggtggaaagcgggaaatttgggtgatttgttgattggcaatgaggataaaatgttaatacttttttggggacttaacaactttatcctattctacaagtcagtaaaggaacaattggtactcacctcagtgctgcactcaactatggaaagaggcagagtttgcttgcccaattgccaaactaaagacatcagttcattggtcaaatatttgttacctggaatggaacttgaaagcaaatacatttggatttcaaatttc

SEQ ID NO: 32191 - DNA, 4936 bp, Homo sapiens
actacaaaggatgtctgtgatgacagtggccatcccatttgatcctcgttattcttcttttatcgaaggaaactgagagtcaccttcttttctaggcagttaggtaactgaagccgaaaggtattgtgacagatccactgggctgtaaaaggcagcgtgtggaggtggagcccagagtttctgcctccacagttaaaagctcagacagggctttgggagcagggcctgcaaatcaaagatgaaagaacaacctgtcttggagcgcttgcagtcccagaaatcctggattaaaggagtatttgacaagagagaatgtagcacaatcatacccagctcaaaaaatcctcacagatgtactccagtatgccaagtctgccagaatttaatcaggtgttactgtggccgactgattggagaccatgctgggatagattattcctggaccatctcagctgccaagggtaaagaaagtgaacaatggtctgttgaaaagcacacaacgaaaagcccaacagatacttttggcacgattaatttccaagatggagagcacacccatcatgccaagtatattagaacttcttatgatacaaaactggatcatctgttacatttaatgttgaaagagtggaaaatggaactgcccaagcttgtgatctcagtccatgggggcatccagaactttactatgccctctaaatttaaagagattttcagccaaggtttggttaaagctgcagagacaacaggagcgtggataataactgaaggcatcaatacaggagtgtccaagcatgttggggatgccttgaaatcccattcctctcattccttgagaaaaatctggacagttggaatccctccttggggtgtcattgagaaccagagagaccttattggaaaagatgtggtgtgcctgtaccagactctggataaccccctcagcaagctcacaacactcaacagcatgcactcgcacttcatcctgtctgatgatgggaccgtgggcaagtatggaaatgaaatgaagctcagaaggaacctggagaagtacctctctctgcagaaaatacactgccgctcaagacaaggcgtgccggtcgtggggctggtggtggaaggcggtcccaacgtcatcctgtcagtgtgggagactgtcaaggacaaggacccagtggtggtgtgtgagggcacaggtagggcggctgacctcctggccttcacacacaaacacctggcagatgaagggatgctgcgacctcaggtgaaagaggagatcatctgcatgattcagaacactttcaactttagtcttaaacagtccaagcaccttttccaaattctaatggagtgtatggttcacagggattgtattaccatatttgatgctgactctgaagagcagcaagacctggacttagcaatcctaacagctttgctgaagggcacaaatttatcagcgtcagagcaattaaatctggcaatggcttgggacagggtggacattgccaagaaacatatcctaatttatgaacaacactggaagcctgatgccctggaacaagcaatgtcagatgctttagtgatggatcgggtggattttgtgaagctcttaatagaatatggagtgaacctccatcgctttcttaccatccctcgactggaagagctctacaatacaaaacaaggacctactaatacactcttgcatcatctcgtccaagatgtgaaacaggatctcagcaaaaactctttgtggaattccaggagcaccaacctcaataggaactccctccatgtaattaaaatgccaatctcctctctaatttcagagatctcagcctccttaaaaagccctcaagagcctcaccatcattattcagccattgaaaggaataatttaatgaggctttctcagaccataccatttacaccagtccaactgtttgcaggagaagaaataactgtctacaggttggaggagagttcccctttaaaccttgataaaagcatgtcctcttggtctcagcgtgggagagcggcaatgatccaggtattgtcccgagaggagatggatgggggcctccgtaaagctatgagagtcgtcagcacttggtctgaggatgacattctcaagccgggacaagttttcattgtcaagtcctttcttcctgaggttgtgcggacatggcataaaatcttccaggagagcactgtgcttcatctttgcctcagggaaattcaacaacaaagagctgctcaaaaattgatctataccttcaaccaagtgaaaccacaaaccataccctacacaccaaggttcctggaagttttcttaatctactgccattcagccaaccagtggttgaccattgagaagtatatgacaggggagttccggaagtataacaacaacaatggtgatgaaatcacccccaccaacaccctggaggagctgatgttggctttctctcactggacctatgagtacactcggggagagctgctggttttagatttgcaaggtgttggagaaaatttgacagatccatctgttataaaacctgaagtcaaacaatcaagaggaatggtgtttggaccggccaatttgggggaagatgcaattagaaacttcattgcaaaacatcattgtaactcctgctgccggaagctcaaactcccggatttaaaaagaaatgactattcccctgaaaggataaattccacctttggacttgagataaaaatagaatcagctgaggagcctccagcaagggagacgggtagaaattccccagaagatgatatgcaactataaaaagggaggagcaagaagatcccagtgcttgccctgcctgccaggaactctgtgataacatagattgatcaacgtgatgttgattacatcagcgtctccttgggacacgccttctgagcctcacatctccttctgttcaaaggcctcattggtatatgatcaatgggttctcctagacactgacctctgtccagggcactttgcagctccatcctcaagttccacacgaagatgcttggatgagtcagctgggaatattgttcttgtgtacctcattgctttagctggtcacttggaactttggagcagaatcctgcacattaaaggatggggttgggggggatacatttattttattttctcactatgtatgcagactggaccccctactactatttgtcacctcacccacagattgtatttatgtctatatatatgttcataaaaagttatgtgatttcctcctctgtcttttccacaacataggactttgaatagcaatgataggaaaaacaatggaacaagggtgggtttgcacagattggagcacattcctgcacaaactaccaagtatactggtgaaatctcgatgggtttcagatattgtcagtgaatcatatgatgcctggatatttcaggtttctgtaaaagaaagggaaacctaaaacaaatacccttccatatataatatatatggaatatgtatattatatatatttttatatatataatatatatggaatatatatattatatatataaaatacatatggaatatatatattttatatatatatatatatatttttatttttgagatggagtttcactctttttacccaggctggagtgcaatgatgcgatctcactgcaacctctgcctcccgggcttgagcgattcttgtgtctcagtcttccgggtagctgggactacaggtgtgcaccactatgcctggctaattttgtatttttagtagagatggggtttcaccatgttggccaggctggtctcaaactcctgacctcagatgatccacctgccttggcttcccaaagtgctgggattacaggcgtgagccactgcgcctggcctttttttttttttttttaaacgagaacaagaatatgaagaactggaaatcattaagaaagggtttcccttccttaaagctcaggggtactattagttaggagttgactaactcaacctgtaaaacaccactcctccttccaaagttgtatatataatattgcaggttaaattactttatgtcaggtcctatgaagaaagatacggtttcagactgaaaacatgtttcacaggtgtttgcttccttccagagcagagttccctattcccctggcataaagaatgtatatatattttgaaatatggctgagaacatgtcattggtttgtgaggcctaaggtgaagcactcctggcagccacactgtgtagtgtatttgagggatcagtcatccctcttgtatgctgggcctggttgccctacctcgaacaagcaccagcttttcacacaaggagagatgtggggctgggagtcctctccccatcctattgcatctcctttcttattataagctgttccagttcacaggcagcaaacctcctgggtttgaaaaattccaacttatttttatctttaatcctgacattagctgacttgctagtgagcttgctttaaaaatctacactcttgcattcttaggcatacaggggaaatgttgaaaaggaaggtggaaaaccaagaatttagtttgccaatgattgcctctgattcttgtaagtttgagttccacaagggctaatttattccccttttacttgggttttggggtggtggaaagcgggaaatttgggtgatttgttgattggcaatgaggataaaatgttaatacttttttggggacttaacaactttatcctattctacaagtcagtaaaggaacaattggtactcacctcagtgctgcactcaactatggaaagaggcagagtttgcttgcccaattgccaaactaaagacatcagttcattggtcaaatatttgttacctggaatggaacttgaaagcaaatacatttggatttcaaatttc

SEQ ID NO: 32192 - DNA, 5290 bp, Homo sapiens
actacaaaggatgtctgtgatgacagtggccatcccatttgatcctcgttattcttcttttatcgaaggaaactgagagtcaccttcttttctaggcagttaggtaactgaagccgaaaggtattgtgacagatccactgggctgtaaaaggcagcgtgtggaggtggagcccagagtttctgcctccacagttaaaagctcagacagggctttgggagcagggcctgcaaatcaaagatgaaagaacaacctgtcttggagcgcttgcagtcccagaaatcctggattaaaggagtatttgacaagagagaatgtagcacaatcatacccagctcaaaaaatcctcacagatgtactccagtatgccaagtctgccagaatttaatcaggtgttactgtggccgactgattggagaccatgctgggatagattattcctggaccatctcagctgccaagggtaaagaaagtgaacaatggtctgttgaaaagcacacaacgaaaagcccaacagatacttttggcacgattaatttccaagatggagagcacacccatcatgccaagtatattagaacttcttatgatacaaaactggatcatctgttacatttaatgttgaaagagtggaaaatggaactgcccaagcttgtgatctcagtccatgggggcatccagaactttactatgccctctaaatttaaagagattttcagccaaggtttggttaaagctgcagagacaacaggagcgtggataataactgaaggcatcaatacaggagtgtccaagcatgttggggatgccttgaaatcccattcctctcattccttgagaaaaatctggacagttggaatccctccttggggtgtcattgagaaccagagagaccttattggaaaagatgtggtgtgcctgtaccagactctggataaccccctcagcaagctcacaacactcaacagcatgcactcgcacttcatcctgtctgatgatgggaccgtgggcaagtatggaaatgaaatgaagctcagaaggaacctggagaagtacctctctctgcagaaaatacactgccgctcaagacaaggcgtgccggtcgtggggctggtggtggaaggcggtcccaacgtcatcctgtcagtgtgggagactgtcaaggacaaggacccagtggtggtgtgtgagggcacaggtagggcggctgacctcctggccttcacacacaaacacctggcagatgaagggatgctgcgacctcaggtgaaagaggagatcatctgcatgattcagaacactttcaactttagtcttaaacagtccaagcaccttttccaaattctaatggagtgtatggttcacagggattgtattaccatatttgatgctgactctgaagagcagcaagacctggacttagcaatcctaacagctttgctgaagggcacaaatttatcagcgtcagagcaattaaatctggcaatggcttgggacagggtggacattgccaagaaacatatcctaatttatgaacaacactggaagcctgatgccctggaacaagcaatgtcagatgctttagtgatggatcgggtggattttgtgaagctcttaatagaatatggagtgaacctccatcgctttcttaccatccctcgactggaagagctctacaatacaaaacaaggacctactaatacactcttgcatcatctcgtccaagatgtgaaacagcatacccttctttcaggctaccgaataaccttgattgacattggattagtagtagaatacctcattggtagagcatatcgcagcaactacactagaaaacatttcagagccctctacaacaacctctacagaaaatacaagatcataacagtcaatgcctgctctcagagtgaccagttgaatccagagccaggagaaaacagcatctctgaagaggagtacagcaagaactggttcacagtgtccaaatttagtcacacaggtgtagaaccttacatacatcagaaaatgaaaactaaagaaattggacaatgtgctatacaaatcagtgattacctaaagcagtctcaagaggatctcagcaaaaactctttgtggaattccaggagcaccaacctcaataggaactccctccatgtaattaaaatgccaatctcctctctaatttcagagatctcagcctccttaaaaagccctcaagagcctcaccatcattattcagccattgaaaggaataatttaatgaggctttctcagaccataccatttacaccagtccaactgtttgcaggagaagaaataactgtctacaggttggaggagagttcccctttaaaccttgataaaagcatgtcctcttggtctcagcgtgggagagcggcaatgatccaggtattgtcccgagaggagatggatgggggcctccgtaaagctatgagagtcgtcagcacttggtctgaggatgacattctcaagccgggacaagttttcattgtcaagtcctttcttcctgaggttgtgcggacatggcataaaatcttccaggagagcactgtgcttcatctttgcctcagggaaattcaacaacaaagagctgctcaaaaattgatctataccttcaaccaagtgaaaccacaaaccataccctacacaccaaggttcctggaagttttcttaatctactgccattcagccaaccagtggttgaccattgagaagtatatgacaggggagttccggaagtataacaacaacaatggtgatgaaatcacccccaccaacaccctggaggagctgatgttggctttctctcactggacctatgagtacactcggggagagctgctggttttagatttgcaaggtgttggagaaaatttgacagatccatctgttataaaacctgaagtcaaacaatcaagaggaatggtgtttggaccggccaatttgggggaagatgcaattagaaacttcattgcaaaacatcattgtaactcctgctgccggaagctcaaactcccggatttaaaaagaaatgactattcccctgaaaggataaattccacctttggacttgagataaaaatagaatcagctgaggagcctccagcaagggagacgggtagaaattccccagaagatgatatgcaactataaaaagggaggagcaagaagatcccagtgcttgccctgcctgccaggaactctgtgataacatagattgatcaacgtgatgttgattacatcagcgtctccttgggacacgccttctgagcctcacatctccttctgttcaaaggcctcattggtatatgatcaatgggttctcctagacactgacctctgtccagggcactttgcagctccatcctcaagttccacacgaagatgcttggatgagtcagctgggaatattgttcttgtgtacctcattgctttagctggtcacttggaactttggagcagaatcctgcacattaaaggatggggttgggggggatacatttattttattttctcactatgtatgcagactggaccccctactactatttgtcacctcacccacagattgtatttatgtctatatatatgttcataaaaagttatgtgatttcctcctctgtcttttccacaacataggactttgaatagcaatgataggaaaaacaatggaacaagggtgggtttgcacagattggagcacattcctgcacaaactaccaagtatactggtgaaatctcgatgggtttcagatattgtcagtgaatcatatgatgcctggatatttcaggtttctgtaaaagaaagggaaacctaaaacaaatacccttccatatataatatatatggaatatgtatattatatatatttttatatatataatatatatggaatatatatattatatatataaaatacatatggaatatatatattttatatatatatatatatatttttatttttgagatggagtttcactctttttacccaggctggagtgcaatgatgcgatctcactgcaacctctgcctcccgggcttgagcgattcttgtgtctcagtcttccgggtagctgggactacaggtgtgcaccactatgcctggctaattttgtatttttagtagagatggggtttcaccatgttggccaggctggtctcaaactcctgacctcagatgatccacctgccttggcttcccaaagtgctgggattacaggcgtgagccactgcgcctggcctttttttttttttttttaaacgagaacaagaatatgaagaactggaaatcattaagaaagggtttcccttccttaaagctcaggggtactattagttaggagttgactaactcaacctgtaaaacaccactcctccttccaaagttgtatatataatattgcaggttaaattactttatgtcaggtcctatgaagaaagatacggtttcagactgaaaacatgtttcacaggtgtttgcttccttccagagcagagttccctattcccctggcataaagaatgtatatatattttgaaatatggctgagaacatgtcattggtttgtgaggcctaaggtgaagcactcctggcagccacactgtgtagtgtatttgagggatcagtcatccctcttgtatgctgggcctggttgccctacctcgaacaagcaccagcttttcacacaaggagagatgtggggctgggagtcctctccccatcctattgcatctcctttcttattataagctgttccagttcacaggcagcaaacctcctgggtttgaaaaattccaacttatttttatctttaatcctgacattagctgacttgctagtgagcttgctttaaaaatctacactcttgcattcttaggcatacaggggaaatgttgaaaaggaaggtggaaaaccaagaatttagtttgccaatgattgcctctgattcttgtaagtttgagttccacaagggctaatttattccccttttacttgggttttggggtggtggaaagcgggaaatttgggtgatttgttgattggcaatgaggataaaatgttaatacttttttggggacttaacaactttatcctattctacaagtcagtaaaggaacaattggtactcacctcagtgctgcactcaactatggaaagaggcagagtttgcttgcccaattgccaaactaaagacatcagttcattggtcaaatatttgttacctggaatggaacttgaaagcaaatacatttggatttcaaatttc

SEQ ID NO: 32193 - DNA, 4651 bp, Homo sapiens
actacaaaggatgtctgtgatgacagtggccatcccatttgatcctcgttattcttcttttatcgaaggaaactgagagtcaccttcttttctaggcagttaggtaactgaagccgaaaggtattgtgacagatccactgggctgtaaaaggcagcgtgtggaggtggagcccagagtttctgcctccacagttaaaagctcagacagggctttgggagcagggcctgcaaatcaaagatgaaagaacaacctgtcttggagcgcttgcagtcccagaaatcctggattaaaggagtatttgacaagagagaatgtagcacaatcatacccagctcaaaaaatcctcacagatgtactccagtatgccaagtctgccagaatttaatcaggtgttactgtggccgactgattggagaccatgctgggatagattattcctggaccatctcagctgccaagggtaaagaaagtgaacaatggtctgttgaaaagcacacaacgaaaagcccaacagatacttttggcacgattaatttccaagatggagagcacacccatcatgccaagtatattagaacttcttatgatacaaaactggatcatctgttacatttaatgttgaaagagtggaaaatggaactgcccaagcttgtgatctcagtccatgggggcatccagaactttactatgccctctaaatttaaagagattttcagccaaggtttggttaaagctgcagagacaacaggagcgtggataataactgaaggcatcaatacaggagtgtccaagcatgttggggatgccttgaaatcccattcctctcattccttgagaaaaatctggacagttggaatccctccttggggtgtcattgagaaccagagagaccttattggaaaagatgtggtgtgcctgtaccagactctggataaccccctcagcaagctcacaacactcaacagcatgcactcgcacttcatcctgtctgatgatgggaccgtgggcaagtatggaaatgaaatgaagctcagaaggaacctggagaagtacctctctctgcagaaaatacactgccgctcaagacaaggcgtgccggtcgtggggctggtggtggaaggcggtcccaacgtcatcctgtcagtgtgggagactgtcaaggacaaggacccagtggtggtgtgtgagggcacaggtagggcggctgacctcctggccttcacacacaaacacctggcagatgaagggatgctgcgacctcaggtgaaagaggagatcatctgcatgattcagaacactttcaactttagtcttaaacagtccaagcaccttttccaaattctaatggagtgtatggttcacagggattgtattaccatatttgatgctgactctgaagagcagcaagacctggacttagcaatcctaacagctttgctgaagggcacaaatttatcagcgtcagagcaattaaatctggcaatggcttgggacagggtggacattgccaagaaacatatcctaatttatgaacaacactggaagcctgatgccctggaacaagcaatgtcagatgctttagtgatggatcgggtggattttgtgaagctcttaatagaatatggagtgaacctccatcgctttcttaccatccctcgactggaagagctctacaatacaaaacaaggacctactaatacactcttgcatcatctcgtccaagatgtgaaacagcatacccttctttcaggctaccgaataaccttgattgacattggattagtagtagaatacctcattggtagagcatatcgcagcaactacactagaaaacatttcagagccctctacaacaacctctacagaaaatacaagcaccagagacactcctcaggaaatagaaatgagtctgcagaaagtacgctgcactcccagttcattagaactgcacagccatacaaattcaaggaaaagtctatagtccttcataaatcaaggaagaagtcaaaagaacaaaatgtatcagatgaccctgagtctactggctttctttacccttacaatgacctgctggtttgggctgtgctgatgaaaaggcagaagatggctatgttcttctggcagcatggagaggaggccacggttaaagccgtgattgcgtgtatcctctaccgggcaatggcccatgaagctaaggagagtcacatggtggatgatgcctcagaagagttgaagaattactcaaaacagtttggccagctggctctggacttgttggagaaggcattcaagcagaatgagcgcatggccatgacgctgttgacgtatgaactcaggaactggagcaattcgacctgccttaaactggccgtgtcgggaggattacgaccctttgtttcacatacttgtacccagatgctactgacagacatgtggatggggaggctgaaaatgaggaaaaactcttggttaaagattattataagcattattttaccacccaccattttgacactggaatttaaaagcaaagctgagatgtcacatgttccccagtcccaggacttccaatttatgtggtattacagtgaccagaacgccagcagttccaaagaaagtgcttctgtgaaagagtatgatttggaaaggggccatgatgagaaactggatgaaaatcagcattttggtttggaaagtgggcaccaacaccttccgtggaccaggaaagtctatgagttctacagtgctccaattgtcaagttttggttttatacgatggcgtatttggcattcctcatgctgttcacttacaccgtgttggtggagatgcagccccagcccagcgtgcaggagtggcttgttagcatttacatcttcaccaatgctattgaggtggtcagggagatctgtatttcagaacctgggaagtttacccaaaaggtgaaggtatggattagtgagtactggaacttaacagaaactgtggccattggcctgttttcagctggcttcgtccttcgatggggtgaccctccttttcacacagcgggaagactgatctactgcatagacatcatattctggttctcacggctcctggacttctttgctgtgaatcaacatgcaggtccatatgtgaccatgattgcaaaaatgacagcaaacatgttctatattgtgatcatcatggccatagtcctgctgagctttggagtggcacgcaaggccatcctttcgccaaaagagccaccatcttggagtctagctcgagatattgtatttgagccatactggatgatatacggagaagtctatgctggagaaatagatgtttgttcaagccagccatcctgccctcctggttcttttcttactccattcttgcaagctgtctacctcttcgtgcaatatatcatcatggtgaacctgttgattgctttcttcaacaacgtttacttagatatggaatccatttcaaataacctgtggaaatacaaccgctatcgctacatcatgacctaccacgagaagccctggctgcccccacctctcatcctgctgagccacgtgggccttctcctccgccgcctgtgctgtcatcgagctcctcacgaccaagaagagggtgacgttggattaaaactctacctcagtaaggaggatctgaaaaaacttcatgattttgaggagcagtgcgtggaaaaatacttccatgagaagatggaagatgtgaattgtagttgtgaggaacgaatccgagtgacatcagaaagggttacagagatgtacttccagctgaaagaaatgaatgaaaaggtgtcttttataaaggactccttactgtctttggacagccaggtgggacacctgcaggatctctctgccctgactgtggataccctgaaagtcctttctgctgttgacactttgcaagaggatgaggctctcctggccaagagaaagcattctacttgcaaaaaacttccccacagctggagcaatgtcatctgtgcagaggttctaggcagcatggagatcgctggagagaagaaataccagtattatagcatgccctcttctttgctgaggagcctggctggaggccggcatcccccaagagtgcagaggggggcacttcttgagattacaaacagtaaaagagaggctacaaatgtaagaaatgaccaggaaaggcaagaaacacaaagtagtatagtggtttctggggtgtctcctaacaggcaagcacactcaaagtatggccagtttcttctggtcccctctaatctaaagcgagttcctttttcagcagaaactgtcttgcctctgtccagaccctctgtgccagatgtgctggcaactgaacaggacatccagactgaggttcttgttcatctgactgggcagaccccagttgtctctgactgggcatcagtggatgaacccaaggaaaagcacgagcctattgctcacttactggatggacaagacaaggcagagcaagtgctacccactttgagttgcacacctgaacccatgacaatgagctcccctctttccagatacaggcccttcgctaggagtcatagttttagattccataaggaggagaaattgatgaagatctgtaagattaaaagtaaggaataa

SEQ ID NO: 32194 - DNA, 8244 bp, Homo sapiens
atctaacgaggatctagaatagctaggatttatgaaataccggctttcaagttctctggtctccacccaaagatgattatcctatctaagtcccagaaatcctggattaaaggagtatttgacaagagagaatgtagcacaatcatacccagctcaaaaaatcctcacagatgtactccagtatgccaagtctgccagaatttaatcaggtgttactgtggccgactgattggagaccatgctgggatagattattcctggaccatctcagctgccaagggtaaagaaagtgaacaatggtctgttgaaaagcacacaacgaaaagcccaacagatacttttggcacgattaatttccaagatggagagcacacccatcatgccaagtatattagaacttcttatgatacaaaactggatcatctgttacatttaatgttgaaagagtggaaaatggaactgcccaagcttgtgatctcagtccatgggggcatccagaactttactatgccctctaaatttaaagagattttcagccaaggtttggttaaagctgcagagacaacaggagcgtggataataactgaaggcatcaatacaggagtgtccaagcatgttggggatgccttgaaatcccattcctctcattccttgagaaaaatctggacagttggaatccctccttggggtgtcattgagaaccagagagaccttattggaaaagatgtggtgtgcctgtaccagactctggataaccccctcagcaagctcacaacactcaacagcatgcactcgcacttcatcctgtctgatgatgggaccgtgggcaagtatggaaatgaaatgaagctcagaaggaacctggagaagtacctctctctgcagaaaatacactgccgctcaagacaaggcgtgccggtcgtggggctggtggtggaaggcggtcccaacgtcatcctgtcagtgtgggagactgtcaaggacaaggacccagtggtggtgtgtgagggcacaggtagggcggctgacctcctggccttcacacacaaacacctggcagatgaagggatgctgcgacctcaggtgaaagaggagatcatctgcatgattcagaacactttcaactttagtcttaaacagtccaagcaccttttccaaattctaatggagtgtatggttcacagggattgtattaccatatttgatgctgactctgaagagcagcaagacctggacttagcaatcctaacagctttgctgaagggcacaaatttatcagcgtcagagcaattaaatctggcaatggcttgggacagggtggacattgccaagaaacatatcctaatttatgaacaacactggaagcctgatgccctggaacaagcaatgtcagatgctttagtgatggatcgggtggattttgtgaagctcttaatagaatatggagtgaacctccatcgctttcttaccatccctcgactggaagagctctacaatacaaaacaaggacctactaatacactcttgcatcatctcgtccaagatgtgaaacagcatacccttctttcaggctaccgaataaccttgattgacattggattagtagtagaatacctcattggtagagcatatcgcagcaactacactagaaaacatttcagagccctctacaacaacctctacagaaaatacaagcaccagagacactcctcaggaaatagaaatgagtctgcagaaagtacgctgcactcccagttcattagaactgcacagccatacaaattcaaggaaaagtctatagtccttcataaatcaaggaagaagtcaaaagaacaaaatgtatcagatgaccctgagtctactggctttctttacccttacaatgacctgctggtttgggctgtgctgatgaaaaggcagaagatggctatgttcttctggcagcatggagaggaggccacggttaaagccgtgattgcgtgtatcctctaccgggcaatggcccatgaagctaaggagagtcacatggtggatgatgcctcagaagagttgaagaattactcaaaacagtttggccagctggctctggacttgttggagaaggcattcaagcagaatgagcgcatggccatgacgctgttgacgtatgaactcaggaactggagcaattcgacctgccttaaactggccgtgtcgggaggattacgaccctttgtttcacatacttgtacccagatgctactgacagacatgtggatggggaggctgaaaatgaggaaaaactcttggttaaagattattataagcattattttaccacccaccattttgacactggaatttaaaagcaaagctgagatgtcacatgttccccagtcccaggacttccaatttatgtggtattacagtgaccagaacgccagcagttccaaagaaagtgcttctgtgaaagagtatgatttggaaaggggccatgatgagaaactggatgaaaatcagcattttggtttggaaagtgggcaccaacaccttccgtggaccaggaaagtctatgagttctacagtgctccaattgtcaagttttggttttatacgatggcgtatttggcattcctcatgctgttcacttacaccgtgttggtggagatgcagccccagcccagcgtgcaggagtggcttgttagcatttacatcttcaccaatgctattgaggtggtcagggagatctgtatttcagaacctgggaagtttacccaaaaggtgaaggtatggattagtgagtactggaacttaacagaaactgtggccattggcctgttttcagctggcttcgtccttcgatggggtgaccctccttttcacacagcgggaagactgatctactgcatagacatcatattctggttctcacggctcctggacttctttgctgtgaatcaacatgcaggtccatatgtgaccatgattgcaaaaatgacagcaaacatgttctatattgtgatcatcatggccatagtcctgctgagctttggagtggcacgcaaggccatcctttcgccaaaagagccaccatcttggagtctagctcgagatattgtatttgagccatactggatgatatacggagaagtctatgctggagaaatagatgtttgttcaagccagccatcctgccctcctggttcttttcttactccattcttgcaagctgtctacctcttcgtgcaatatatcatcatggtgaacctgttgattgctttcttcaacaacgtttacttagatatggaatccatttcaaataacctgtggaaatacaaccgctatcgctacatcatgacctaccacgagaagccctggctgcccccacctctcatcctgctgagccacgtgggccttctcctccgccgcctgtgctgtcatcgagctcctcacgaccaagaagagggtgacgttggattaaaactctacctcagtaaggaggatctgaaaaaacttcatgattttgaggagcagtgcgtggaaaaatacttccatgagaagatggaagatgtgaattgtagttgtgaggaacgaatccgagtgacatcagaaagggttacagagatgtacttccagctgaaagaaatgaatgaaaaggtgtcttttataaaggactccttactgtctttggacagccaggtgggacacctgcaggatctctctgccctgactgtggataccctgaaagtcctttctgctgttgacactttgcaagaggatgaggctctcctggccaagagaaagcattctacttgcaaaaaacttccccacagctggagcaatgtcatctgtgcagaggttctaggcagcatggagatcgctggagagaagaaataccagtattatagcatgccctcttctttgctgaggagcctggctggaggccggcatcccccaagagtgcagaggggggcacttcttgagattacaaacagtaaaagagaggctacaaatgtaagaaatgaccaggaaaggcaagaaacacaaagtagtatagtggtttctggggtgtctcctaacaggcaagcacactcaaagtatggccagtttcttctggtcccctctaatctaaagcgagttcctttttcagcagaaactgtcttgcctctgtccagaccctctgtgccagatgtgctggcaactgaacaggacatccagactgaggttcttgttcatctgactgggcagaccccagttgtctctgactgggcatcagtggatgaacccaaggaaaagcacgagcctattgctcacttactggatggacaagacaaggcagagcaagtgctacccactttgagttgcacacctgaacccatgacaatgagctcccctctttcccaagccaagatcatgcaaactggaggtggatatgtaaactgggcattttcagaaggtgatgaaactggtgtgtttagcatcaagaaaaagtggcaaacctgcttgccctccacttgtgacagtgattcctctcggagtgaacagcaccagaagcaggcccaggacagctccctatctgataactcaacaagatcggcccagagtagtgaatgctcagaggtgggaccatggcttcagccaaacacatccttttggatcaatcctctccgcagatacaggcccttcgctaggagtcatagttttagattccataaggaggagaaattgatgaagatctgtaagattaaaaatctttcaggctcttcagaaatagggcagggagcatgggtcaaagcgaaaatgctaaccaaagacaggagactgtcaaagaaaaagaagaatactcaaggactccaggtgccaatcataacagtcaatgcctgctctcagagtgaccagttgaatccagagccaggagaaaacagcatctctgaagaggagtacagcaagaactggttcacagtgtccaaatttagtcacacaggtgtagaaccttacatacatcagaaaatgaaaactaaagaaattggacaatgtgctatacaaatcagtgattacctaaagcagtctcaagaggatctcagcaaaaactctttgtggaattccaggagcaccaacctcaataggaactccctgctgaaaagttcaattggagttgacaagatctcagcctccttaaaaagccctcaagagcctcaccatcattattcagccattgaaaggaataatttaatgaggctttctcagaccataccatttacaccagtccaactgtttgcaggagaagaaataactgtctacaggttggaggagagttcccctttaaaccttgataaaagcatgtcctcttggtctcagcgtgggagagcggcaatgatccaggtattgtcccgagaggagatggatgggggcctccgtaaagctatgagagtcgtcagcacttggtctgaggatgacattctcaagccgggacaagttttcattgtcaagtcctttcttcctgaggttgtgcggacatggcataaaatcttccaggagagcactgtgcttcatctttgcctcagggaaattcaacaacaaagagctgctcaaaaattgatctataccttcaaccaagtgaaaccacaaaccataccctacacaccaaggttcctggaagttttcttaatctactgccattcagccaaccagtggttgaccattgagaagtatatgacaggggagttccggaagtataacaacaacaatggtgatgaaatcacccccaccaacaccctggaggagctgatgttggctttctctcactggacctatgagtacactcggggagagctgctggttttagatttgcaaggtgttggagaaaatttgacagatccatctgttataaaacctgaagtcaaacaatcaagaggaatggtgtttggaccggccaatttgggggaagatgcaattagaaacttcattgcaaaacatcattgtaactcctgctgccggaagctcaaactcccggatttaaaaagaaatgactattcccctgaaaggataaattccacctttggacttgagataaaaatagaatcagctgaggagcctccagcaagggagacgggtagaaattccccagaagatgatatgcaactataaaaagggaggagcaagaagatcccagtgcttgccctgcctgccaggaactctgtgataacatagattgatcaacgtgatgttgattacatcagcgtctccttgggacacgccttctgagcctcacatctccttctgttcaaaggcctcattggtatatgatcaatgggttctcctagacactgacctctgtccagggcactttgcagctccatcctcaagttccacacgaagatgcttggatgagtcagctgggaatattgttcttgtgtacctcattgctttagctggtcacttggaactttggagcagaatcctgcacattaaaggatggggttgggggggatacatttattttattttctcactatgtatgcagactggaccccctactactatttgtcacctcacccacagattgtatttatgtctatatatatgttcataaaaagttatgtgatttcctcctctgtcttttccacaacataggactttgaatagcaatgataggaaaaacaatggaacaagggtgggtttgcacagattggagcacattcctgcacaaactaccaagtatactggtgaaatctcgatgggtttcagatattgtcagtgaatcatatgatgcctggatatttcaggtttctgtaaaagaaagggaaacctaaaacaaatacccttccatatataatatatatggaatatgtatattatatatatttttatatatataatatatatggaatatatatattatatatataaaatacatatggaatatatatattttatatatatatatatatatttttatttttgagatggagtttcactctttttacccaggctggagtgcaatgatgcgatctcactgcaacctctgcctcccgggcttgagcgattcttgtgtctcagtcttccgggtagctgggactacaggtgtgcaccactatgcctggctaattttgtatttttagtagagatggggtttcaccatgttggccaggctggtctcaaactcctgacctcagatgatccacctgccttggcttcccaaagtgctgggattacaggcgtgagccactgcgcctggcctttttttttttttttttaaacgagaacaagaatatgaagaactggaaatcattaagaaagggtttcccttccttaaagctcaggggtactattagttaggagttgactaactcaacctgtaaaacaccactcctccttccaaagttgtatatataatattgcaggttaaattactttatgtcaggtcctatgaagaaagatacggtttcagactgaaaacatgtttcacaggtgtttgcttccttccagagcagagttccctattcccctggcataaagaatgtatatatattttgaaatatggctgagaacatgtcattggtttgtgaggcctaaggtgaagcactcctggcagccacactgtgtagtgtatttgagggatcagtcatccctcttgtatgctgggcctggttgccctacctcgaacaagcaccagcttttcacacaaggagagatgtggggctgggagtcctctccccatcctattgcatctcctttcttattataagctgttccagttcacaggcagcaaacctcctgggtttgaaaaattccaacttatttttatctttaatcctgacattagctgacttgctagtgagcttgctttaaaaatctacactcttgcattcttaggcatacaggggaaatgttgaaaaggaaggtggaaaaccaagaatttagtttgccaatgattgcctctgattcttgtaagtttgagttccacaagggctaatttattccccttttacttgggttttggggtggtggaaagcgggaaatttgggtgatttgttgattggcaatgaggataaaatgttaatacttttttggggacttaacaactttatcctattctacaagtcagtaaaggaacaattggtactcacctcagtgctgcactcaactatggaaagaggcagagtttgcttgcccaattgccaaactaaagacatcagttcattggtcaaatatttgttacctggaatggaacttgaaagcaaatacatttggatttcaaatttc

SEQ ID NO: 32195 - DNA, 8437 bp, Homo sapiens
actacaaaggatgtctgtgatgacagtggccatcccatttgatcctcgttattcttcttttatcgaaggaaactgagagtcaccttcttttctaggcagttaggtaactgaagccgaaaggtattgtgacagatccactgggctgtaaaaggcagcgtgtggaggtggagcccagagtttctgcctccacagttaaaagctcagacagggctttgggagcagggcctgcaaatcaaagatgaaagaacaacctgtcttggagcgcttgcagtcccagaaatcctggattaaaggagtatttgacaagagagaatgtagcacaatcatacccagctcaaaaaatcctcacagatgtactccagtatgccaagtctgccagaatttaatcaggtgttactgtggccgactgattggagaccatgctgggatagattattcctggaccatctcagctgccaagggtaaagaaagtgaacaatggtctgttgaaaagcacacaacgaaaagcccaacagatacttttggcacgattaatttccaagatggagagcacacccatcatgccaagtatattagaacttcttatgatacaaaactggatcatctgttacatttaatgttgaaagagtggaaaatggaactgcccaagcttgtgatctcagtccatgggggcatccagaactttactatgccctctaaatttaaagagattttcagccaaggtttggttaaagctgcagagacaacaggagcgtggataataactgaaggcatcaatacaggagtgtccaagcatgttggggatgccttgaaatcccattcctctcattccttgagaaaaatctggacagttggaatccctccttggggtgtcattgagaaccagagagaccttattggaaaagatgtggtgtgcctgtaccagactctggataaccccctcagcaagctcacaacactcaacagcatgcactcgcacttcatcctgtctgatgatgggaccgtgggcaagtatggaaatgaaatgaagctcagaaggaacctggagaagtacctctctctgcagaaaatacactgccgctcaagacaaggcgtgccggtcgtggggctggtggtggaaggcggtcccaacgtcatcctgtcagtgtgggagactgtcaaggacaaggacccagtggtggtgtgtgagggcacaggtagggcggctgacctcctggccttcacacacaaacacctggcagatgaagggatgctgcgacctcaggtgaaagaggagatcatctgcatgattcagaacactttcaactttagtcttaaacagtccaagcaccttttccaaattctaatggagtgtatggttcacagggattgtattaccatatttgatgctgactctgaagagcagcaagacctggacttagcaatcctaacagctttgctgaagggcacaaatttatcagcgtcagagcaattaaatctggcaatggcttgggacagggtggacattgccaagaaacatatcctaatttatgaacaacactggaagcctgatgccctggaacaagcaatgtcagatgctttagtgatggatcgggtggattttgtgaagctcttaatagaatatggagtgaacctccatcgctttcttaccatccctcgactggaagagctctacaatacaaaacaaggacctactaatacactcttgcatcatctcgtccaagatgtgaaacagcatacccttctttcaggctaccgaataaccttgattgacattggattagtagtagaatacctcattggtagagcatatcgcagcaactacactagaaaacatttcagagccctctacaacaacctctacagaaaatacaagcaccagagacactcctcaggaaatagaaatgagtctgcagaaagtacgctgcactcccagttcattagaactgcacagccatacaaattcaaggaaaagtctatagtccttcataaatcaaggaagaagtcaaaagaacaaaatgtatcagatgaccctgagtctactggctttctttacccttacaatgacctgctggtttgggctgtgctgatgaaaaggcagaagatggctatgttcttctggcagcatggagaggaggccacggttaaagccgtgattgcgtgtatcctctaccgggcaatggcccatgaagctaaggagagtcacatggtggatgatgcctcagaagagttgaagaattactcaaaacagtttggccagctggctctggacttgttggagaaggcattcaagcagaatgagcgcatggccatgacgctgttgacgtatgaactcaggaactggagcaattcgacctgccttaaactggccgtgtcgggaggattacgaccctttgtttcacatacttgtacccagatgctactgacagacatgtggatggggaggctgaaaatgaggaaaaactcttggttaaagattattataagcattattttaccacccaccattttgacactggaatttaaaagcaaagctgagatgtcacatgttccccagtcccaggacttccaatttatgtggtattacagtgaccagaacgccagcagttccaaagaaagtgcttctgtgaaagagtatgatttggaaaggggccatgatgagaaactggatgaaaatcagcattttggtttggaaagtgggcaccaacaccttccgtggaccaggaaagtctatgagttctacagtgctccaattgtcaagttttggttttatacgatggcgtatttggcattcctcatgctgttcacttacaccgtgttggtggagatgcagccccagcccagcgtgcaggagtggcttgttagcatttacatcttcaccaatgctattgaggtggtcagggagatctgtatttcagaacctgggaagtttacccaaaaggtgaaggtatggattagtgagtactggaacttaacagaaactgtggccattggcctgttttcagctggcttcgtccttcgatggggtgaccctccttttcacacagcgggaagactgatctactgcatagacatcatattctggttctcacggctcctggacttctttgctgtgaatcaacatgcaggtccatatgtgaccatgattgcaaaaatgacagcaaacatgttctatattgtgatcatcatggccatagtcctgctgagctttggagtggcacgcaaggccatcctttcgccaaaagagccaccatcttggagtctagctcgagatattgtatttgagccatactggatgatatacggagaagtctatgctggagaaatagatgtttgttcaagccagccatcctgccctcctggttcttttcttactccattcttgcaagctgtctacctcttcgtgcaatatatcatcatggtgaacctgttgattgctttcttcaacaacgtttacttagatatggaatccatttcaaataacctgtggaaatacaaccgctatcgctacatcatgacctaccacgagaagccctggctgcccccacctctcatcctgctgagccacgtgggccttctcctccgccgcctgtgctgtcatcgagctcctcacgaccaagaagagggtgacgttggattaaaactctacctcagtaaggaggatctgaaaaaacttcatgattttgaggagcagtgcgtggaaaaatacttccatgagaagatggaagatgtgaattgtagttgtgaggaacgaatccgagtgacatcagaaagggttacagagatgtacttccagctgaaagaaatgaatgaaaaggtgtcttttataaaggactccttactgtctttggacagccaggtgggacacctgcaggatctctctgccctgactgtggataccctgaaagtcctttctgctgttgacactttgcaagaggatgaggctctcctggccaagagaaagcattctacttgcaaaaaacttccccacagctggagcaatgtcatctgtgcagaggttctaggcagcatggagatcgctggagagaagaaataccagtattatagcatgccctcttctttgctgaggagcctggctggaggccggcatcccccaagagtgcagaggggggcacttcttgagattacaaacagtaaaagagaggctacaaatgtaagaaatgaccaggaaaggcaagaaacacaaagtagtatagtggtttctggggtgtctcctaacaggcaagcacactcaaagtatggccagtttcttctggtcccctctaatctaaagcgagttcctttttcagcagaaactgtcttgcctctgtccagaccctctgtgccagatgtgctggcaactgaacaggacatccagactgaggttcttgttcatctgactgggcagaccccagttgtctctgactgggcatcagtggatgaacccaaggaaaagcacgagcctattgctcacttactggatggacaagacaaggcagagcaagtgctacccactttgagttgcacacctgaacccatgacaatgagctcccctctttcccaagccaagatcatgcaaactggaggtggatatgtaaactgggcattttcagaaggtgatgaaactggtgtgtttagcatcaagaaaaagtggcaaacctgcttgccctccacttgtgacagtgattcctctcggagtgaacagcaccagaagcaggcccaggacagctccctatctgataactcaacaagatcggcccagagtagtgaatgctcagaggtgggaccatggcttcagccaaacacatccttttggatcaatcctctccgcagatacaggcccttcgctaggagtcatagttttagattccataaggaggagaaattgatgaagatctgtaagattaaaaatctttcaggctcttcagaaatagggcagggagcatgggtcaaagcgaaaatgctaaccaaagacaggagactgtcaaagaaaaagaagaatactcaaggactccaggtgccaatcataacagtcaatgcctgctctcagagtgaccagttgaatccagagccaggagaaaacagcatctctgaagaggagtacagcaagaactggttcacagtgtccaaatttagtcacacaggtgtagaaccttacatacatcagaaaatgaaaactaaagaaattggacaatgtgctatacaaatcagtgattacctaaagcagtctcaagaggatctcagcaaaaactctttgtggaattccaggagcaccaacctcaataggaactccctccatgtaattaaaatgccaatctcctctctaatttcagagatctcagcctccttaaaaagccctcaagagcctcaccatcattattcagccattgaaaggaataatttaatgaggctttctcagaccataccatttacaccagtccaactgtttgcaggagaagaaataactgtctacaggttggaggagagttcccctttaaaccttgataaaagcatgtcctcttggtctcagcgtgggagagcggcaatgatccaggtattgtcccgagaggagatggatgggggcctccgtaaagctatgagagtcgtcagcacttggtctgaggatgacattctcaagccgggacaagttttcattgtcaagtcctttcttcctgaggttgtgcggacatggcataaaatcttccaggagagcactgtgcttcatctttgcctcagggaaattcaacaacaaagagctgctcaaaaattgatctataccttcaaccaagtgaaaccacaaaccataccctacacaccaaggttcctggaagttttcttaatctactgccattcagccaaccagtggttgaccattgagaagtatatgacaggggagttccggaagtataacaacaacaatggtgatgaaatcacccccaccaacaccctggaggagctgatgttggctttctctcactggacctatgagtacactcggggagagctgctggttttagatttgcaaggtgttggagaaaatttgacagatccatctgttataaaacctgaagtcaaacaatcaagaggaatggtgtttggaccggccaatttgggggaagatgcaattagaaacttcattgcaaaacatcattgtaactcctgctgccggaagctcaaactcccggatttaaaaagaaatgactattcccctgaaaggataaattccacctttggacttgagataaaaatagaatcagctgaggagcctccagcaagggagacgggtagaaattccccagaagatgatatgcaactataaaaagggaggagcaagaagatcccagtgcttgccctgcctgccaggaactctgtgataacatagattgatcaacgtgatgttgattacatcagcgtctccttgggacacgccttctgagcctcacatctccttctgttcaaaggcctcattggtatatgatcaatgggttctcctagacactgacctctgtccagggcactttgcagctccatcctcaagttccacacgaagatgcttggatgagtcagctgggaatattgttcttgtgtacctcattgctttagctggtcacttggaactttggagcagaatcctgcacattaaaggatggggttgggggggatacatttattttattttctcactatgtatgcagactggaccccctactactatttgtcacctcacccacagattgtatttatgtctatatatatgttcataaaaagttatgtgatttcctcctctgtcttttccacaacataggactttgaatagcaatgataggaaaaacaatggaacaagggtgggtttgcacagattggagcacattcctgcacaaactaccaagtatactggtgaaatctcgatgggtttcagatattgtcagtgaatcatatgatgcctggatatttcaggtttctgtaaaagaaagggaaacctaaaacaaatacccttccatatataatatatatggaatatgtatattatatatatttttatatatataatatatatggaatatatatattatatatataaaatacatatggaatatatatattttatatatatatatatatatttttatttttgagatggagtttcactctttttacccaggctggagtgcaatgatgcgatctcactgcaacctctgcctcccgggcttgagcgattcttgtgtctcagtcttccgggtagctgggactacaggtgtgcaccactatgcctggctaattttgtatttttagtagagatggggtttcaccatgttggccaggctggtctcaaactcctgacctcagatgatccacctgccttggcttcccaaagtgctgggattacaggcgtgagccactgcgcctggcctttttttttttttttttaaacgagaacaagaatatgaagaactggaaatcattaagaaagggtttcccttccttaaagctcaggggtactattagttaggagttgactaactcaacctgtaaaacaccactcctccttccaaagttgtatatataatattgcaggttaaattactttatgtcaggtcctatgaagaaagatacggtttcagactgaaaacatgtttcacaggtgtttgcttccttccagagcagagttccctattcccctggcataaagaatgtatatatattttgaaatatggctgagaacatgtcattggtttgtgaggcctaaggtgaagcactcctggcagccacactgtgtagtgtatttgagggatcagtcatccctcttgtatgctgggcctggttgccctacctcgaacaagcaccagcttttcacacaaggagagatgtggggctgggagtcctctccccatcctattgcatctcctttcttattataagctgttccagttcacaggcagcaaacctcctgggtttgaaaaattccaacttatttttatctttaatcctgacattagctgacttgctagtgagcttgctttaaaaatctacactcttgcattcttaggcatacaggggaaatgttgaaaaggaaggtggaaaaccaagaatttagtttgccaatgattgcctctgattcttgtaagtttgagttccacaagggctaatttattccccttttacttgggttttggggtggtggaaagcgggaaatttgggtgatttgttgattggcaatgaggataaaatgttaatacttttttggggacttaacaactttatcctattctacaagtcagtaaaggaacaattggtactcacctcagtgctgcactcaactatggaaagaggcagagtttgcttgcccaattgccaaactaaagacatcagttcattggtcaaatatttgttacctggaatggaacttgaaagcaaatacatttggatttcaaatttc

SEQ ID NO: 32196 - DNA, 7263 bp, Homo sapiens
gcgccgctcacgtggtccgtccccagccccgtcgccggcggaggcgggcgcgggcgcgtccctgtggccagtcacccggaggagttggtcgcacaattatgaaagactcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttccggagtccgccccgtgaggagaatgtcccagaaatcctggatagaaagcactttgaccaagagggaatgtgtatatattataccaagttccaaggaccctcacagatgccttccaggatgtcaaatttgtcagcaactcgtcaggtgtttttgtggtcgcttggtcaagcaacatgcttgttttactgcaagtcttgccatgaaatactcagatgtgaaattgggtgaccattttaatcaggcaatagaagaatggtctgtggaaaagcatacagaacagagcccaacggatgcttatggagtcataaattttcaagggggttctcattcctacagagctaagtatgtgaggctatcatatgacaccaaacctgaagtcattctgcaacttctgcttaaagaatggcaaatggagttacccaaacttgttatctctgtacatgggggcatgcagaaatttgagcttcacccacgaatcaagcagttgcttggaaaaggtcttattaaagctgcagttacaactggagcctggattttaactggaggagtaaacacaggtgtggcaaaacatgttggagatgccctcaaagaacatgcttccagatcatctcgaaagatttgcactatcggaatagctccatggggagtgattgaaaacagaaatgatcttgttgggagagatgtggttgctccttatcaaaccttattgaaccccctgagcaaattgaatgttttgaataatctgcattcccatttcatattggtggatgatggcactgttggaaagtatggggcggaagtcagactgagaagagaacttgaaaaaactattaatcagcaaagaattcatgctaggattggccagggtgtccctgtggtggcacttatatttgagggtgggccaaatgttatcctcacagttcttgaataccttcaggaaagcccccctgttccagtagttgtgtgtgaaggaacaggcagagctgcagatctgctagcgtatattcataaacaaacagaagaaggagggaatcttcctgatgcagcagagcccgatattatttccactatcaaaaaaacatttaactttggccagaatgaagcacttcatttatttcaaacactgatggagtgcatgaaaagaaaggagcttatcactgttttccatattgggtcagatgaacatcaagatatagatgtagcaatacttactgcactgctaaaaggtactaatgcatctgcatttgaccagcttatccttacattggcatgggatagagttgacattgccaaaaatcatgtatttgtttatggacagcagtggctggttggatccttggaacaagctatgcttgatgctcttgtaatggatagagttgcatttgtaaaacttcttattgaaaatggagtaagcatgcataaattccttaccattccgagactggaagaactttacaacactaaacaaggtccaactaatccaatgctgtttcatcttgttcgagacgtcaaacagggaaatcttcctccaggatataagatcactctgattgatataggacttgttattgaatatctcatgggaggaacctacagatgcacctatactaggaaacgttttcgattaatatataatagtcttggtggaaataatcggaggtctggccgaaatacctccagcagcactcctcagttgcgaaagagtcatgaatcttttggcaatagggcagataaaaaggaaaaaatgaggcataaccatttcattaagacagcacagccctaccgaccaaagattgatacagttatggaagaaggaaagaagaaaagaaccaaagatgaaattgtagacattgatgatccagaaaccaagcgctttccttatccacttaatgaacttttaatttgggcttgccttatgaagaggcaggtcatggcccgttttttatggcaacatggtgaagaatcaatggctaaagcattagttgcctgtaagatctatcgttcaatggcatatgaagcaaagcagagtgacctggtagatgatacttcagaagaactaaaacagtattccaatgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggaagtgtttaaagaagtacggattttggatagtaatgaaggaaagaatgagatggagatacaaatgaaatcaaaaaagcttccaattacgcgaaagttttatgccttttatcatgcaccaattgtaaaattctggtttaacacgttggcatatttaggatttctgatgctttatacatttgtggttcttgtacaaatggaacagttaccttcagttcaagaatggattgttattgcttatatttttacttatgccattgagaaagtccgtgagatctttatgtctgaagctgggaaagtaaaccagaagattaaagtatggtttagtgattacttcaacatcagtgatacaattgccataatttctttcttcattggatttggactaagatttggagcaaaatggaactttgcaaatgcatatgataatcatgtttttgtggctggaagattaatttactgtcttaacataatattttggtatgtgcgtttgctagattttctagctgtaaatcaacaggcaggaccttatgtaatgatgattggaaaaatggtggccaatatgttctacattgtagtgattatggctcttgtattacttagttttggtgttcccagaaaggcaatactttatcctcatgaagcaccatcttggactcttgctaaagatatagtttttcacccatactggatgatttttggtgaagtttatgcatacgaaattgatgtgtgtgcaaatgattctgttatccctcaaatctgtggtcctgggacgtggttgactccatttcttcaagcagtctacctctttgtacagtatatcattatggttaatcttcttattgcatttttcaacaatgtgtatttacaagtgaaggcaatttccaatattgtatggaagtaccagcgttatcattttattatggcttatcatgagaaaccagttctgcctcctccacttatcattcttagccatatagtttctctgttttgctgcatatgtaagagaagaaagaaagataagacttccgatggaccaaaacttttcttaacagaagaagatcaaaagaaacttcatgattttgaagagcagtgtgttgaaatgtatttcaatgaaaaagatgacaaatttcattctgggagtgaagagagaattcgtgtcacttttgaaagagtggaacagatgtgcattcagattaaagaagttggagatcgtgtcaactacataaaaagatcattacaatcattagattctcaaattggccatttgcaagatctttcagccctgacggtagatacattaaaaacactcactgcccagaaagcgtcggaagctagcaaagttcataatgaaatcacacgagaactgagcatttccaaacacttggctcaaaaccttattgatgatggtcctgtaagaccttctgtatggaaaaagcatggtgttgtaaatacacttagctcctctcttcctcaaggtgatcttgaaagtaataatccttttcattgtaatattttaatgaaagatgacaaagatccccagtgtaatatatttggtcaagacttacctgcagtaccccagagaaaagaatttaattttccagaggctggttcctcttctggtgccttattcccaagtgctgtttcccctccagaactgcgacagagactacatggggtagaactcttaaaaatatttaataaaaatcaaaaattaggcagttcatctactagcataccacatctgtcatccccaccaaccaaattttttgttagtacaccatctcagccaagttgcaaaagccacttggaaactggaaccaaagatcaagaaactgtttgctctaaagctacagaaggagataatacagaatttggagcatttgtaggacacagagatagcatggatttacagaggtttaaagaaacatcaaacaagataaaaatactatccaataacaatacttctgaaaacactttgaaacgagtgagttctcttgctggatttactgactgtcacagaacttccattcctgttcattcaaaacaagcagaaaaaatcagtagaaggccatctaccgaagacactcatgaagtagattccaaagcagctttaataccggattggttacaagatagaccatcaaacagagaaatgccatctgaagaaggaacattaaatggtctcacttctccatttaagccagctatggatacaaattactattattcagctgtggaaagaaataacttgatgaggttatcacagagcattccatttacacctgtgcctccaagaggggagcctgtcacagtgtatcgtttggaagagagttcacccaacatactaaataacagcatgtcttcttggtcacaactaggcctctgtgccaaaatagagtttttaagcaaagaggagatgggaggaggtttacgaagagctgtcaaagtacagtgtacctggtcagaacatgatatcctcaaatcagggcatctttatattatcaaatcttttcttccagaggtggttaatacatggtcaagtatttacaaagaagatacagttctgcatctctgtctgagagaaattcaacaacagagagcagcacaaaagcttacgtttgcctttaatcaaatgaaacccaaatccataccatattctccaaggttccttgaagttttcctgctgtattgccattcagcaggacagtggtttgctgtggaagaatgtatgactggagaatttagaaaatacaacaataataatggagatgagattattccaactaatactctggaagagatcatgctagcctttagccactggacttacgaatatacaagaggggagttactggtacttgatttgcaaggtgttggtgaaaatttgactgacccatctgtgataaaagcagaagaaaagagatcctgtgatatggtttttggcccagcaaatctaggagaagatgcaattaaaaacttcagagcaaaacatcactgtaattcttgctgtagaaagcttaaacttccagatctgaagaggaatgattatacgcctgataaaattatatttcctcaggatgagccttcagatttgaatcttcagcctggaaattccaccaaagaatcagaatcaactaattctgttcgtctgatgttataatattaatattactgaatcattggttttgcctgcacctcacagaaatgttactgtgtcacttttccctcgggaggaaattgtttggtaatatagaaaggtgtatgcaagttgaatttgctgactccagcacagttaaaaggtcaatattcttttgacctgattaatcagtcagaaagtccctataggatagagctggcagctgagaaattttaaaggtaattgataattagtatttataactttttaaagggctctttgtatagcagaggatctcatttgactttgttttgatgagggtgatgctctctcttatgtggtacaataccattaaccaaaggtaggtgtccatgcagattttattggcagctgttttattgccattcaactagggaaatgaagaaatcacgcagccttttggttaaatggcagtcaaaattttcctcagtgtatttagtgtgttcagtgatgatatcactggttcccaactagatgcttgttggccacgggaagggaaatgacttgttctaattctaggttcacagaggtatgagaagcctgaactgaagaccattttcaagagggacggtatttatgaatcagggttaggctccatatttaaagatagagccagtttttttttttaaatagaacccaaattgtgtaaaaatgttaattgggttttttaaacattgttttatcaagtcactgttaagtagaagaaagccatggtaaactgatacataacctaaattataaaagcagaaacctaactcactcgtcaagggaagttaccttttgaggaaagttaaagtacttttttccctatctgtatctatagcaacaacccagaacttacaaacttctccaaagattttattgattgttatatcaaatcagaatgtaaacatgaactcttgcatatatttaaaattgtgttggaacatttgaacatgaatgctgtttgtggtacttaagaaattaattcagttggattatcattatgtgatactggcagattgcagtgcaaccttatgccaataaaatgtaatttaacagccccagatattgttgaatattcaacaataacaagaaaagcttttcatctaagttttatgctttaattttttttctttttttttctttttcttttgtttccttggtactaattttaatttttatttggaagggagcagtataaagcttatttgtatttagtagtgtatctcatagatacagacaaggcaagagatgataagctgtttaaatagtgtttaatattgattgggggtggggagaaagaaaaagtgtattacttaaagatactatatacgttttgtatatcattaaatctttaaaagaaatgaaataaatttattgtttaca

SEQ ID NO: 32197 - DNA, 5621 bp, Homo sapiens
aagaaaatcctgcttgacaaaaaccgtcacttaggaaaagatgtcctttcgggcagccaggctcagcatgaggaacagaaggaatgacactctggacagcacccggaccctgtactccagcgcgtctcggagcacagacttgtcttacagtgaaagcgacttggtgaattttattcaagcaaattttaagaaacgagaatgtgtcttctttaccaaagattccaaggccacggagaatgtgtgcaagtgtggctatgcccagagccagcacatggaaggcacccagatcaaccaaagtgagaaatggaactacaagaaacacaccaaggaatttcctaccgacgcctttggggatattcagtttgagacactggggaagaaagggaagtatatacgtctgtcctgcgacacggacgcggaaatcctttacgagctgctgacccagcactggcacctgaaaacacccaacctggtcatttctgtgaccgggggcgccaagaacttcgccctgaagccgcgcatgcgcaagatcttcagccggctcatctacatcgcgcagtccaaaggtgcttggattctcacgggaggcacccattatggcctgatgaagtacatcggggaggtggtgagagataacaccatcagcaggagttcagaggagaatattgtggccattggcatagcagcttggggcatggtctccaaccgggacaccctcatcaggaattgcgatgctgagggctattttttagcccagtaccttatggatgacttcacaagagatccactgtatatcctggacaacaaccacacacatttgctgctcgtggacaatggctgtcatggacatcccactgtcgaagcaaagctccggaatcagctagagaagtatatctctgagcgcactattcaagattccaactatggtggcaagatccccattgtgtgttttgcccaaggaggtggaaaagagactttgaaagccatcaatacctccatcaaaaataaaattccttgtgtggtggtggaaggctcgggccagatcgctgatgtgatcgctagcctggtggaggtggaggatgccctgacatcttctgccgtcaaggagaagctggtgcgctttttaccccgcacggtgtcccggctgcctgaggaggagactgagagttggatcaaatggctcaaagaaattctcgaatgttctcacctattaacagttattaaaatggaagaagctggggatgaaattgtgagcaatgccatctcctacgctctatacaaagccttcagcaccagtgagcaagacaaggataactggaatgggcagctgaagcttctgctggagtggaaccagctggacttagccaatgatgagattttcaccaatgaccgccgatgggagtctgctgaccttcaagaagtcatgtttacggctctcataaaggacagacccaagtttgtccgcctctttctggagaatggcttgaacctacggaagtttctcacccatgatgtcctcactgaactcttctccaaccacttcagcacgcttgtgtaccggaatctgcagatcgccaagaattcctataatgatgccctcctcacgtttgtctggaaactggttgcgaacttccgaagaggcttccggaaggaagacagaaatggccgggacgagatggacatagaactccacgacgtgtctcctattactcggcaccccctgcaagctctcttcatctgggccattcttcagaataagaaggaactctccaaagtcatttgggagcagaccaggggctgcactctggcagccctgggagccagcaagcttctgaagactctggccaaagtgaagaacgacatcaatgctgctggggagtccgaggagctggctaatgagtacgagacccgggctgttgagctgttcactgagtgttacagcagcgatgaagacttggcagaacagctgctggtctattcctgtgaagcttggggtggaagcaactgtctggagctggcggtggaggccacagaccagcatttcatcgcccagcctggggtccagaattttctttctaagcaatggtatggagagatttcccgagacaccaagaactggaagattatcctgtgtctgtttattatacccttggtgggctgtggctttgtatcatttaggaagaaacctgtcgacaagcacaagaagctgctttggtactatgtggcgttcttcacctcccccttcgtggtcttctcctggaatgtggtcttctacatcgccttcctcctgctgtttgcctacgtgctgctcatggatttccattcggtgccacacccccccgagctggtcctgtactcgctggtctttgtcctcttctgtgatgaagtgagacagtggtacgtaaatggggtgaattattttactgacctgtggaatgtgatggacacgctggggcttttttacttcatagcaggaattgtatttcggctccactcttctaataaaagctctttgtattctggacgagtcattttctgtctggactacattattttcactctaagattgatccacatttttactgtaagcagaaacttaggacccaagattataatgctgcagaggatgctgatcgatgtgttcttcttcctgttcctctttgcggtgtggatggtggcctttggcgtggccaggcaagggatccttaggcagaatgagcagcgctggaggtggatattccgttcggtcatctacgagccctacctggccatgttcggccaggtgcccagtgacgtggatggtaccacgtatgactttgcccactgcaccttcactgggaatgagtccaagccactgtgtgtggagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggtgaagaagtgcttcaagtgttgctgcaaggagaaaaacatggagtcttctgtctgctgtttcaaaaatgaagacaatgagactctggcatgggagggtgtcatgaaggaaaactaccttgtcaagatcaacacaaaagccaacgacacctcagaggaaatgaggcatcgatttagacaactggatacaaagcttaatgatctcaagggtcttctgaaagagattgctaataaaatcaaataaaactgtatgaactctaatggagaaaaatctaattatagcaagatcatattaaggaatgctgatgaacaattttgctatcgactactaaatgagagattttcagacccctgggtacatggtggatgattttaaatcaccctagtgtgctgagaccttgagaataaagtgtgtgattggtttcatacttgaagacggatataaaggaagaatatttcctttatgtgtttctccagaatggtgcctgtttctctctgtgtctcaatgcctgggactggaggttgatagtttaagtgtgttcttaccgcctcctttttcctttaatcttatttttgatgaacacatatataggagaacatctatcctatgaataagaacctggtcatgctttactcctgtattgttattttgttcatttccaattgattctctacttttcccttttttgtattatgtgactaattagttggcatattgttaaaagtctctcaaattaggccagattctaaaacatgctgcagcaagaggaccccgctctcttcaggaaaagtgttttcatttctcaggatgcttcttacctgtcagaggaggtgacaaggcagtctcttgctctcttggactcaccaggctcctattgaaggaaccacccccattcctaaatatgtgaaaagtcgcccaaaatgcaaccttgaaaggcactactgactttgttcttattggatactcctcttattatttttccattaaaaataatagctggctattatagaaaatttagaccatacagagatgtagaaagaacataaattgtccccattaccttaaggtaatcactgctaacaatttctggatggtttttcaagtctattttttttctatgtatgtctcaattctctttcaaaattttacagaatgttatcatactacatatatactttttatgtaagctttttcacttagtattttatcaaatatgtttttattatattcatagccttcttaaacattatatcaataattgcataataggcaacctctagcgattaccataattttgctcattgaaggctatctccagttgatcattgggatgagcatctttgtgcatgaatcctattgctgtatttgggaaaattttccaaggttagattccaataaatatctatttattattaaatattaaaatatctatttattattaaaaccatttataaggctttttcataaatgtatagcaaataggaattattaacttgagcataagatatgagatacatgaacctgaactattaaaataaaatattatatttaacccttagtttaagaagaagtcaatatgcttatttaaatattatggatggtgggcagatcacttgaggtcaggagttcgagaccagcctggccaacatggcaaaaccacatctctactaaaaataaaaaaattagctgggtgtggtggtgcactcctgtaatcccagctactcagaaggctgaggtacaagaattgctggaacctgggaggcggaggttgcagtgaaccaagattgcaccactgcactccagccggggtgacagagtgagactccgactgaaaataaataaataaataaataaataaataaataaatattatggatggtgaagggaatggtatagaattggagagattatcttactgaacacctgtagtcccagctttctctggaagtggtcgtatttgagcaggatgtgcacaaggcaattgaaatgcccataattagtttctcagctttgaatacactataaactcactggctgaaggaggaaattttagaaggaagctactaaaagatctaatttgaaaaactacaaaagcattaactaaaaaagtttattttccttttgtctgggcagtagtgaaaataactactcacaacattcactatgtttgcaaggaattaacacaaataaaagatgcctttttacttaaacaccaagacagaaaacttgcccaatactgagaagcaacttgcattagagagggaactgttaaatgttttcaacccagttcatctggtggatgtttttgcaggttactctgagaattttgcttatgaaaaatcattatttttagtgtagttcacaataatgtattgaacatacttctaatcaaaggtgctatgtccttgtgtatggtactaaatgtgtcctgtgtacttttgcacaactgagaatcctgcagcttggtttaatgagtgtgttcatgaaataaataatggaggaattgtca

SEQ ID NO: 32198 - DNA, 904 bp, Homo sapiens
ctgcctttctccaccagagactcttcctcagggaggacttggtgaattttattcaagcaaattttaagaaacgagaatgtgtcttctttaccaaagattccaaggccacgctcaatgaaatccttccttcctgtccacaccatcgtgcttatcagggagaatgtgtgcaagtgtggctatgcccagagccagcacatggaaggcacccagatcaaccaaagtgagaaatggaactacaagaaacacaccaaggaatttcctaccgacgcctttggggatattcagtttgagacactggggaagaaagggaagtatatacgtctgtcctgcgacacggacgcggaaatcctttacgagctgctgacccagcactggcacctgaaaacacccaacctggtcatttctgtgaccgggggcgccaagaacttcgccctgaagccgcgcatgcgcaagatcttcagccggctcatctacatcgcgcagtccaaaggtgcttggattctcacgggaggcacccattatggcctgatgaagtacatcggggaggtggtgagagataacaccatcagcaggagttcagaggagaatattgtggccattggcatagcagcttggggcatggtctccaaccgggacaccctcatcaggaattgcgatgctgaggtaccggtgggacaggaggaggtctgctaggtcacatggaagaaagaccatggcatgggcctgtggcctgaaccctggggctctgtgatggagccagccagatcatggggaagtctgcctttcaaggagtgcctttgggaccttaaaggaattgaaaacaaggatgacgtacctaattaactgctgggaaagagttaacaatgaatgttttgttcattaaaatgtgttctcagcaatctca

SEQ ID NO: 32199 - DNA, 722 bp, Homo sapiens
ctcagggaggacttggtgaattttattcaagcaaattttaagaaacgagaatgtgtcttctttaccaaagattccaaggccacggagaatgtgtgcaagtgtggctatgcccagagccagcacatggaaggcacccagatcaaccaaagtgagaaatggaactacaagaaacacaccaaggaatttcctaccgacgcctttggggatattcagtttgagacactggggaagaaagggaagtatatacgtctgtcctgcgacacggacgcggaaatcctttacgagctgctgacccagcactggcacctgaaaacacccaacctggtcatttctgtgaccgggggcgccaagaacttcgccctgaagccgcgcatgcgcaagatcttcagccggctcatctacatcgcgcagtccaaaggtgcttggattctcacgggaggcacccattatggcctgatgaagtacatcggggaggtggtgagagataacaccatcagcaggagttcagaggagaatattgtggccattggcatagcagcttggggcatggtctccaaccgggacaccctcatcaggaattgcgatgctgaggtaccggtgggacaggaggaggtctgctaggtcacatggaagaaagaccatggcatgggcctgtggcctgaaccctggggctctgtgatggagccagccagatcatggggaagtctgcctttcaaggagtg

SEQ ID NO: 32200 - DNA, 3348 bp, Homo sapiens
tcctgcttgacaaaaaccgtcacttaggaaaagatgtcctttcgggcagccaggctcagcatgaggaacagaaggaatgacactctggacagcacccggaccctgtactccagcgcgtctcggagcacagacttgtcttacagtgaaagcgacttggtgaattttattcaagcaaattttaagaaacgagaatgtgtcttctttaccaaagattccaaggccacggagaatgtgtgcaagtgtggctatgcccagagccagcacatggaaggcacccagatcaaccaaagtgagaaatggaactacaagaaacacaccaaggaatttcctaccgacgcctttggggatattcagtttgagacactggggaagaaagggaagtatatacgtctgtcctgcgacacggacgcggaaatcctttacgagctgctgacccagcactggcacctgaaaacacccaacctggtcatttctgtgaccgggggcgccaagaacttcgccctgaagccgcgcatgcgcaagatcttcagccggctcatctacatcgcgcagtccaaaggtgcttggattctcacgggaggcacccattatggcctgatgaagtacatcggggaggtggtgagagataacaccatcagcaggagttcagaggagaatattgtggccattggcatagcagcttggggcatggtctccaaccgggacaccctcatcaggaattgcgatgctgagggctattttttagcccagtaccttatggatgacttcacaagagatccactgtatatcctggacaacaaccacacacatttgctgctcgtggacaatggctgtcatggacatcccactgtcgaagcaaagctccggaatcagctagagaagtatatctctgagcgcactattcaagattccaactatggtggcaagatccccattgtgtgttttgcccaaggaggtggaaaagagactttgaaatcaagaagatttgggaggagaatttcagtgacatgaataacctgtgtacttagtgttggccttgacagtcaacctgccaaagagaagagttgacattaattcgggagacttaaagattgtaaccggcatatatattagaaagctatggccaacctatctgcattgagatgagctgtgatcatacacacacagattgcccccaaaccagatgtttccagaccacctaaggcccatttatatgccacctggggatgcaggccatcaatacctccatcaaaaataaaattccttgtgtggtggtggaaggctcgggccagatcgctgatgtgatcgctagcctggtggaggtggaggatgccctgacatcttctgccgtcaaggagaagctggtgcgctttttaccccgcacggtgtcccggctgcctgaggaggagactgagagttggatcaaatggctcaaagaaattctcgaatgttctcacctattaacagttattaaaatggaagaagctggggatgaaattgtgagcaatgccatctcctacgctctatacaaagccttcagcaccagtgagcaagacaaggataactggaatgggcagctgaagcttctgctggagtggaaccagctggacttagccaatgatgagattttcaccaatgaccgccgatgggagtctgctgaccttcaagaagtcatgtttacggctctcataaaggacagacccaagtttgtccgcctctttctggagaatggcttgaacctacggaagtttctcacccatgatgtcctcactgaactcttctccaaccacttcagcacgcttgtgtaccggaatctgcagatcgccaagaattcctataatgatgccctcctcacgtttgtctggaaactggttgcgaacttccgaagaggcttccggaaggaagacagaaatggccgggacgagatggacatagaactccacgacgtgtctcctattactcggcaccccctgcaagctctcttcatctgggccattcttcagaataagaaggaactctccaaagtcatttgggagcagaccaggggctgcactctggcagccctgggagccagcaagcttctgaagactctggccaaagtgaagaacgacatcaatgctgctggggagtccgaggagctggctaatgagtacgagacccgggctgttgagctgttcactgagtgttacagcagcgatgaagacttggcagaacagctgctggtctattcctgtgaagcttggggtggaagcaactgtctggagctggcggtggaggccacagaccagcatttcatcgcccagcctggggtccagtggtacgtaaatggggtgaattattttactgacctgtggaatgtgatggacacgctggggcttttttacttcatagcaggaattgtatttcggctccactcttctaataaaagctctttgtattctggacgagtcattttctgtctggactacattattttcactctaagattgatccacatttttactgtaagcagaaacttaggacccaagattataatgctgcagaggatgctgatcgatgtgttcttcttcctgttcctctttgcggtgtggatggtggcctttggcgtggccaggcaagggatccttaggcagaatgagcagcgctggaggtggatattccgttcggtcatctacgagccctacctggccatgttcggccaggtgcccagtgacgtggatggtaccacgtatgactttgcccactgcaccttcactgggaatgagtccaagccactgtgtgtggagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggtgaagaagtgcttcaagtgttgctgcaaggagaaaaacatggagtcttctgtctgctgtttcaaaaatgaagacaatgagactctggcatgggagggtgtcatgaaggaaaactaccttgtcaagatcaacacaaaagccaacgacacctcagaggaaatgaggcatcgatttagacaactggatacaaagcttaatgatctcaagggtcttctgaaagagattgctaataaaatcaaataaaactgtatgaactctaatggagaaaaatctaattatagcaagatcatattaaggaatgctgatgaacaatttt

SEQ ID NO: 32201 - DNA, 4170 bp, Homo sapiens
ccgaagggcgtccacagcgactcctgctagtgcagggcagctgctgccagggccgggcccgggaccccacggaggcggggagaccactcttctcccacacgagcccagctctcccttcgagtagcaaccgccttcaagctcacaagcacccgtgggcctggggtgtgcctgcgtctagctggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaaggtggccccagcgctgggctcggggagggccccagccctggcctgccctgaccctcccttatgtctttcagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatgctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaactggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtttggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacttctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaatgtttgaaagatcttccatttctaggaaccccagtcctgcttctccgcaatggcacatgcttccactccatccatactggcatcctcaaataaacagatatgtatacat

SEQ ID NO: 32202 - DNA, 2340 bp, Homo sapiens
atgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatgctgggggccaaactgcacccgacgctgaagctggaggagctcaccaacaagaagggaatgacgccgctggctctggcagctgggaccgggaagatcgggaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaactggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtga

SEQ ID NO: 32203 - DNA, 4413 bp, Homo sapiens
ctgccgctcaccctattccagggacacagtctgcttggctcttctggactgagccatcctcatcaccgagatcctccctgaattcagcccacgacagccaccccggccgttttccttgttctgtgtggggagggaggcagcgcggtggttatcaacctcaccctgcagaggaggcacctgaggcccagagacgaggagggatgggtctaacccagaaccacagatggctctgagccgggggcctgtccaccctcccaggccgacgtcagtggccgcaggactgcctgggccctgctaggcctgctcacctctgaggcctctggggtgagaggttcagtcctggaaacacttcagttctagggggctgggggcagcagcaagttggagttttggggtaccctgcttcacagggcccttggcaaggagggcaggtggggtctaaggacaagcagtccttactttgggagtcaaccccggcgtggtggctgctgcaggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatgctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaactggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtttggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacttctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaatgtttgaaagatcttccatttctaggaaccccagtcctgcttctccgcaatggcacatgcttccactccatccatactggcatcctcaaataaacagatatgtatacat

SEQ ID NO: 32204 - DNA, 4087 bp, Homo sapiens
gcagagtgtgcagtatagattcagcgtttgtcgactgactgaatgatagcacaatcccggctgcttcctgttggctgggtttggttggactgggacccgtcagaggaaaaggcaacgccgctgacaaagaacattgccgaaaggttcatgggaggctccggctaacaggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatgctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaactggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtttggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacttctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaatgtttgaaagatcttccatttctaggaaccccagtcctgcttctccgcaatggcacatgcttccactccatccatactggcatcctcaaataaacagatatgtatacat

SEQ ID NO: 32205 - DNA, 2607 bp, Homo sapiens
cagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatgctgggggccaaactgcacccgacgctgaagctggaggagctcaccaacaagaagggaatgacgccgctggctctggcagctgggaccgggaagatcggggttatcgagaatggaccaccgctgtccttcatggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaactggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggcctt

SEQ ID NO: 32206 - DNA, 2776 bp, Homo sapiens
ctctggtggctagcctgtcctgacaggggagagttaagctcccgttctccaccgtgccggctggccaggtgggctgagggtgaccgagagaccagaacctgcttgctggagcttagtgctcagagctggggagggaggttccgccgctcctctgctgtcagcgccggcagcccctcccggcttcacttcctcccgcagcccctgctactgagaagctccgggatcccagcagccgccacgccctggcctcagcctgcggggctccagtcaggccaacaccgacgcgcagctgggaggaagacaggacccttgacatctccatctgcacagaggtcctggctggaccgagcagcctcctcctcctaggatgacctcaccctccagctctccagttttcaggttggagacattagatggaggccaagaagatggctctgaggcggacagaggaaagctggattttgggagcgggctgcctcccatggagtcacagttccagggcgaggaccggaaattcgcccctcagataagagtcaacctcaactaccgaaagggaacaggtgccagtcagccggatccaaaccgatttgaccgagatcggctcttcaatgcggtctcccggggtgtccccgaggatctggctggacttccagagtacctgagcaagaccagcaagtacctcaccgactcggaatacacagagggctccacaggtaagacgtgcctgatgaaggctgtgctgaaccttaaggacggagtcaatgcctgcattctgccactgctgcagatcgacagggactctggcaatcctcagcccctggtaaatgcccagtgcacagatgactattaccgaggccacagcgctctgcacatcgccattgagaagaggagtctgcagtgtgtgaagctcctggtggagaatggggccaatgtgcatgcccgggcctgcggccgcttcttccagaagggccaagggacttgcttttatttcggtgagctacccctctctttggccgcttgcaccaagcagtgggatgtggtaagctacctcctggagaacccacaccagcccgccagcctgcaggccactgactcccagggcaacacagtcctgcatgccctagtgatgatctcggacaactcagctgagaacattgcactggtgaccagcatgtatgatgggctcctccaagctggggcccgcctctgccctaccgtgcagcttgaggacatccgcaacctgcaggatctcacgcctctgaagctggccgccaaggagggcaagatcgagattttcaggcacatcctgcagcgggagttttcaggactgagccacctttcccgaaagttcaccgagtggtgctatgggcctgtccgggtgtcgctgtatgacctggcttctgtggacagctgtgaggagaactcagtgctggagatcattgcctttcattgcaagagcccgcaccgacaccgaatggtcgttttggagcccctgaacaaactgctgcaggcgaaatgggatctgctcatccccaagttcttcttaaacttcctgtgtaatctgatctacatgttcatcttcaccgctgttgcctaccatcagcctaccctgaagaagcaggccgcccctcacctgaaagcggaggttggaaactccatgctgctgacgggccacatccttatcctgctaggggggatctacctcctcgtgggccagctgtggtacttctggcggcgccacgtgttcatctggatctcgttcatagacagctactttgaaatcctcttcctgttccaggccctgctcacagtggtgtcccaggtgctgtgtttcctggccatcgagtggtacctgcccctgcttgtgtctgcgctggtgctgggctggctgaacctgctttactatacacgtggcttccagcacacaggcatctacagtgtcatgatccagaaggtcatcctgcgggacctgctgcgcttccttctgatctacttagtcttccttttcggcttcgctgtagccctggtgagcctgagccaggaggcttggcgccccgaagctcctacaggccccaatgccacagagtcagtgcagcccatggagggacaggaggacgagggcaacggggcccagtacaggggtatcctggaagcctccttggagctcttcaaattcaccatcggcatgggcgagctggccttccaggagcagctgcacttccgcggcatggtgctgctgctgctgctggcctacgtgctgctcacctacatcctgctgctcaacatgctcatcgccctcatgagcgagaccgtcaacagtgtcgccactgacagctggagcatctggaagctgcagaaagccatctctgtcctggagatggagaatggctattggtggtgcaggaagaagcagcgggcaggtgtgatgctgaccgttggcactaagccagatggcagccccgatgagcgctggtgcttcagggtggaggaggtgaactgggcttcatgggagcagacgctgcctacgctgtgtgaggacccgtcaggggcaggtgtccctcgaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaactaa

SEQ ID NO: 32207 - DNA, 796 bp, Homo sapiens
agatttctcattaggtgtgccttcttggtggtgtctgatatgtttcaacattgggcccagcgttgggcccagtcagccggatccaaaccgatttgaccgagatcggctcttcaatgcggtctcccggggtgtccccgaggatctggctggacttccagagtacctgagcaagaccagcaagtacctcaccgactcggaatacacagagggctccacaggtaagacgtgcctgatgaaggctgtgctgaaccttaaggacggagtcaatgcctgcattctgccactgctgcagatcgacagggactctggcaatcctcagcccctggtaaatgcccagtgcacagatgactattaccgaggccacagcgctctgcacatcgccattgagaagaggagtctgcagtgtgtgaagctcctggtggagaatggggccaatgtgcatgcccgggcctgcggccgcttcttccagaagggccaagggacttgcttttatttcggtgagctacccctctctttggccgcttgcaccaagcagtgggatgtggtaagctacctcctggagaacccacaccagcccgccagcctgcaggccactgactcccagggcaacacagtcctgcatgccctagtgatgatctcggacaactcagctgagaacattgcactggtgaccagcatgtatgatgggctcctccaagctggggcccgcctctgccctaccgtgcagcttgaggacatccgcaacctgcaggatctcacgcctctgaagctggccgccaaggagggcaagatcgag

SEQ ID NO: 32208 - DNA, 3420 bp, Homo sapiens
ccacaacttcgatcttggcacctgcggcctcccctgccttttctccggtggggatgaggctgctgtgtgggtgtgggggtgactcacacgggccacgtgggtgggcgggtgctgcagctgtggctggtgggcgtggcctgcctggcgccgagggcaggtggctcagccagttctgcctctgacgcctcattccagccatccctctgcctgcaatgagagcttcccgccgcctcagccacagtcccacccgggggccttgggccccagacatgcggtgatctcagggcaagggttgccacgaccacccagaacctcaccagccatgaaagcccaccccaaggagatggtgcctctcatgggcaagagagttgctgcccccagtgggaaccctgccatcctgccagagaagaggccggcggagatcacccccacaaagaagagtgcacacttcttcctggagatagaagggtttgaacccaaccccacagttgccaagacctctcctcctgtcttctccaagcccatggattccaacatccggcagtgcatctctggtaactgtgatgacatggactccccccagtctcctcaggatgatgtgacagagaccccatccaatcccaacagccccagtgcacagctggccaaggaagagcagaggaggaaaaagaggcggctgaagaagcgcatctttgcagccgtgtctgagggctgcgtggaggagttggtagagttgctggtggagctgcaggagctttgcaggcggcgccatgatgaggatgtgcctgacttcctcatgcacaagctgacggcctccgacacggggaagacctgcctgatgaaggccttgttaaacatcaaccccaacaccaaggagatagtgcggatcctgcttgcctttgctgaagagaacgacatcctgggcaggttcatcaacgccgagtacacagaggaggcctatgaagggcagacggcgctgaacatcgccatcgagcggcggcagggggacatcgcagccctgctcatcgccgccggcgccgacgtcaacgcgcacgccaagggggccttcttcaaccccaagtaccaacacgaaggcttctacttcggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttttttatccaagctgtgcttgtgatactgtctgtcttcttgtacttgtttgcctacaaagagtacctcgcctgcctcgtgctggccatggccctgggctgggcgaacatgctctactatacgcggggtttccagtccatgggcatgtacagcgtcatgatccagaaggtcattttgcatgatgttctgaagttcttgtttgtatatatcgtgtttttgcttggatttggagtagccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagatttcaacaaaatccaagattcttccaggaacaacagcaaaaccactctcaatgcatttgaagaagtcgaggaattcccggaaacctcggtgtagaagcggaacccagagctggtgtgcgcgtgcgctgtctggcgctgcaggcggagtcaccgactctgtgcagagaggctttgagggatggtggagtccggctctgctggcctagaagcagagtgcaccctcgtgctcagtgctcagtgggtgtctgaactgaggggcagttgtcaatttgtctgagtgggaaacatcctggattttgttacttggcaaacagctggtgtaaacctacagccagcagcagtctggagcctgggagcctcctgaagtcccgggtgaagcctctggttttaccaattgcaggtcggcttggctgggagagatggatggcgggaaaggggcagcagtcttgaggagcagggagaggagtctttcctcctgccagcttcccccgtcagccccaaccccagcccacacattgtaccatctcttctgctgtgactgggttgcctgaatttgtgggagacccgtgatcccatcccagagtgtgcgggggacggaggtaagctggatatcctgggggaggaggggaatgcgctctggaaacacccttccggaacccttcggggaaaaggagaccatccttggagtgaacgtcccctgacaccccaaggttcaaactgtctcaagctgagagatgtttttagtagcagaattaacacagggttttaacttgcaatacggaaaagacatttcagttgagaatgaaaattactacaatg

SEQ ID NO: 32209 - DNA, 6113 bp, Homo sapiens
ccacaacttcgatcttggcacctgcggcctcccctgccttttctccggtggggatgaggctgctgtgtgggtgtgggggtgactcacacgggccacgtgggtgggcgggtgctgcagctgtggctggtgggcgtggcctgcctggcgccgagggcaggtggctcagccagttctgcctctgacgcctcattccagccatccctctgcctgcaatgagagcttcccgccgcctcagccacagtcccacccgggggccttgggccccagacatgcggtgatctcagggcaagggttgccacgaccacccagaacctcaccagccatgaaagcccaccccaaggagatggtgcctctcatgggcaagagagttgctgcccccagtgggaaccctgccatcctgccagagaagaggccggcggagatcacccccacaaagaagagtgcacacttcttcctggagatagaagggtttgaacccaaccccacagttgccaagacctctcctcctgtcttctccaagcccatggattccaacatccggcagtgcatctctggtaactgtgatgacatggactccccccagtctcctcaggatgatgtgacagagaccccatccaatcccaacagccccagtgcacagctggccaaggaagagcagaggaggaaaaagaggcggctgaagaagcgcatctttgcagccgtgtctgagggctgcgtggaggagttggtagagttgctggtggagctgcaggagctttgcaggcggcgccatgatgaggatgtgcctgacttcctcatgcacaagctgacggcctccgacacggggaagacctgcctgatgaaggccttgttaaacatcaaccccaacaccaaggagatagtgcggatcctgcttgcctttgctgaagagaacgacatcctgggcaggttcatcaacgccgagtacacagaggaggcctatgaagggcagacggcgctgaacatcgccatcgagcggcggcagggggacatcgcagccctgctcatcgccgccggcgccgacgtcaacgcgcacgccaagggggccttcttcaaccccaagtaccaacacgaaggcttctacttcggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttttttatccaagctgtgcttgtgatactgtctgtcttcttgtacttgtttgcctacaaagagtacctcgcctgcctcgtgctggccatggccctgggctgggcgaacatgctctactatacgcggggtttccagtccatgggcatgtacagcgtcatgatccagaaggtcattttgcatgatgttctgaagttcttgtttgtatatatcgtgtttttgcttggatttggagtagccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagcagatttcaacaaaatccaagattcttccaggaacaacagcaaaaccactctcaatgcatttgaagaagtcgaggaattcccggaaacctcggtgtagaagcggaacccagagctggtgtgcgcgtgcgctgtctggcgctgcaggcggagtcaccgactctgtgcagagaggctttgagggatggtggagtccggctctgctggcctagaagcagagtgcaccctcgtgctcagtgctcagtgggtgtctgaactgaggggcagttgtcaatttgtctgagtgggaaacatcctggattttgttacttggcaaacagctggtgtaaacctacagccagcagcagtctggagcctgggagcctcctgaagtcccgggtgaagcctctggttttaccaattgcaggtcggcttggctgggagagatggatggcgggaaaggggcagcagtcttgaggagcagggagaggagtctttcctcctgccagcttcccccgtcagccccaaccccagcccacacattgtaccatctcttctgctgtgactgggttgcctgaatttgtgggagacccgtgatcccatcccagagtgtgcgggggacggaggtaagctggatatcctgggggaggaggggaatgcgctctggaaacacccttccggaacccttcggggaaaaggagaccatccttggagtgaacgtcccctgacaccccaaggttcaaactgtctcaagctgagagatgtttttagtagcagaattaacacagggttttaacttgcaatacggaaaagacatttcagttgagaatgaaaattactacaatgaagtttgtgattttaaaagtggagacagactgggggctttggggctggatgtaagtattatatatttggcctcagggtgcccagagcaagacaaaaagcttttcttcacacacacaaaagtctgcatgagacactccgggcaagtcctgctgggccgccgcgatctgggtgaaaggtcctggctcttttcctcgtcctgacctcacagtagcgcgtgcctgtgtgctgggatcgtggctttcgctgaagcagaaatagcagctgctcgatcgatatcatcttggaactcagcagttagtcgcatacctcagtatgtctcagtgggggaatttaacaaaatgcctcaactgctttggtacgaagtattttttttttaattttaactgtgaattttgaagctgaaggggaagcttgtgagagaaaagcatttgccaagactttgagcttatttttaggtcctcgtcctctgatgttctctttctgaaatgacacggagtcagtctggggggcagaggtgaagtggagacggaaggattttccaggtgactggggccgaaaccaccagaaaatccactctgccgccgttatctggtgaaaggattcatgtaaaaatgttcgaggtggaattataaaaatagtaaccataaatgttaatcttaaatggcagaaatagaaatttggccttcagataacatggcgatagataagttcatctggcttgaggcaaactgaagagtcggggcctagcagtgcactctgggccagtttctctgccctgggccactctgtgtgccagactagctggacagatagagactttgtgcccctgatggggccgattggggagaggtgggctggggtgtgtgaggcttcacaatccacagcagcccctgccctcccagctgacccagggagtaatcgcgtgctctaagccacagtggtcggggctgggcatgggcctctggagaagagaagatttgaggagaactgtcctagaggcaggaggagcagatgtgtttcagaatgggcagaattaggaaattgagaaagattttggctcaacagaatccagcaactgctccagatgttggagatgtttaagcagaagctggttgcgcacttaatgaggaatgttgttgaaaatggtcattggaagaagtttaaggtcccttttagcctggagattgtacaaatcagcattccacatctggagttagctacccgcattaagcctgaacagacatcttggtctgaaaggaagtggtttggattcatgatgccaagctccacactatggagctgggaattccagaattgctttgactcagatattaatggagaaagtcatatccattaatggataaagccgtatctgttatggataaagccgtatccagagttgctttgactcggatgttaatggataaagccaattattgatttctatttgcctaacctgccagcttttgtccaagtggggaatggagagccatagggatgtttgtcatctcacatgttttggtgatctgctgtctgtgggtctggatggaatttgttggcaagaccattttctgtattggatattcttcccaacagtgtccaccccaaaaggctttcagccaaaacgtctgagcctaggtaggtttaccaagggaagccataagtcaagaagcatcagagtgaaaaggagcacttccttcattttacgcccagaggctaatgctccgagaggaatgtgtacttgggcaaagtcatgcaggaaggtcatatcagagctgtggaggctggagtgtcctgattcttggaccacagatgtctccctgagccattatttatttatttttaaaaagcacagttattccatcattttgagtctttgtatttcgcttatattggggggcaggactattttctcaggtgtctcatttggcagtcaacattgtcccctatgttccctatgactagttgaaaattcaagtgtgcccacaggggtgcacaaaaccacacccatgcacacacacaccctcagcccccacacacaccccgttgaacccgtgggtctatcaggacatcctaaaactccgtgattgacatttcagtaatttcaggggaaggtgttttccagggatggggtctcccaggttcagatagtgcctttggctgcaaatgctcctttagctaaacttttcctcaggaagaattcattattctagacattatgtgatatatctgttaggaataaaaggtgcttaaccttcctccctgggatgtgggagaaggtgctggaggttgtactgtgaagtcttcaggctcttagaaggctccagcctgagagagccctttattattgacattcctgtccttcctcaaggcctggtgacctgtgacctttcgctctgggcagggcccaggtagatgggccgtcatccgggcctgtaagccgtacttgatttctgcattgatttacatattttttactgtgatcttggttccaaacacagaatcgtcaccccattctcccttgaatgtgccggatccttgtaaattctcatttacctacttgttcttagtgtgtatgtgtgtgcgaaactctatgttcaagaaagaaatcatacaaagagtaagaacatgtttgtgccattgaagaaatggttttttgatttctaataaatatttgttttgcctcgtta

SEQ ID NO: 32210 - DNA, 2735 bp, Homo sapiens
gcctcagccacagtcccacccgggggccttgggccccagacatgcggtgatctcagggcaagggttgccacgaccacccagaacctcaccagccatgaaagcccaccccaaggagatggtgcctctcatgggcaagagagttgctgcccccagtgggaaccctgccatcctgccagagaagaggccggcggagatcacccccacaaagaagagtagacatggggtttcaccatgttggcgaggctggtctcaaactcccgacctcaactgatctgcccactttgacctcccagagggctgggattacaggcatgagccaccacacctggcctagcccagctttgaatctggactttgctacctatctgctgcgtgaccttggtgcacacttcttcctggagatagaagggtttgaacccaaccccacagttgccaagacctctcctcctgtcttctccaagcccatggattccaacatccggcagtgcatctctggtaactgtgatgacatggactccccccagtctcctcaggatgatgtgacagagaccccatccaatcccaacagccccagtgcacagctggccaaggaagagcagaggaggaaaaagaggcggctgaagaagcgcatctttgcagccgtgtctgagggctgcgtggaggagttggtagagttgctggtggagctgcaggagctttgcaggcggcgccatgatgaggatgtgcctgacttcctcatgcacaagctgacggcctccgacacggggaagacctgcctgatgaaggccttgttaaacatcaaccccaacaccaaggagatagtgcggatcctgcttgcctttgctgaagagaacgacatcctgggcaggttcatcaacgccgagtacacagaggaggcctatgaagggcagacggcgctgaacatcgccatcgagcggcggcagggggacatcgcagccctgctcatcgccgccggcgccgacgtcaacgcgcacgccaagggggccttcttcaaccccaagtaccaacacgaaggcttctacttcggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttttttatccaagctgtgcttgtgatactgtctgtcttcttgtacttgtttgcctacaaagagtacctcgcctgcctcgtgctggccatggccctgggctgggcgaacatgctctactatacgcggggtttccagtccatgggcatgtacagcgtcatgatccagaaggtcattttgcatgatgttctgaagttcttgtttgtatatatcgtgtttttgcttggatttggagtagccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagcagatttcaacaaaatccaagattcttccaggaacaacagcaaaaccactctcaatgcatttgaagaagtcgaggaattcccggaaacctcggtgtagaagcggaacccagagctggtgtgcgcgtgcgctgtctggcgctgcaggcggagtcaccgactctgtgcagagaggctttgagggatggtggagtcc

SEQ ID NO: 32211 - DNA, 3233 bp, Homo sapiens
gggattcaggaagcgcggatctcccggccgccggcgcccagccgtcccggaggctgagcagtgcagacgggcctggggcaggcatggcggattccagcgaaggcccccgcgcggggcccggggaggtggctgagctccccggggatgagagtggcaccccaggtggggaggcttttcctctctcctccctggccaatctgtttgagggggaggatggctccctttcgccctcaccggctgatgccagtcgccctgctggcccaggcgatgggcgaccaaatctgcgcatgaagttccagggcgccttccgcaagggggtgcccaaccccatcgatctgctggagtccaccctatatgagtcctcggtggtgcctgggcccaagaaagcacccatggactcactgtttgactacggcacctatcgtcaccactccagtgacaacaagaggtggaggaagaagatcatagagaagcagccgcagagccccaaagcccctgcccctcagccgccccccatcctcaaagtcttcaaccggcctatcctctttgacatcgtgtcccggggctccactgctgacctggacgggctgctcccattcttgctgacccacaagaaacgcctaactgatgaggagtttcgagagccatctacggggaagacctgcctgcccaaggccttgctgaacctgagcaatggccgcaacgacaccatccctgtgctgctggacatcgcggagcgcaccggcaacatgagggagttcattaactcgcccttccgtgacatctactatcgaggtcagacagccctgcacatcgccattgagcgtcgctgcaaacactacgtggaacttctcgtggcccagggagctgatgtccacgcccaggcccgtgggcgcttcttccagcccaaggatgaggggggctacttctactttggggagctgcccctgtcgctggctgcctgcaccaaccagccccacattgtcaactacctgacggagaacccccacaagaaggcggacatgcggcgccaggactcgcgaggcaacacagtgctgcatgcgctggtggccattgctgacaacacccgtgagaacaccaagtttgttaccaagatgtacgacctgctgctgctcaagtgtgcccgcctcttccccgacagcaacctggaggccgtgctcaacaacgacggcctctcgcccctcatgatggctgccaagacgggcaagattgggatctttcagcacatcatccggcgggaggtgacggatgaggacacacggcacctgtcccgcaagttcaaggactgggcctatgggccagtgtattcctcgctttatgacctctcctccctggacacgtgtggggaagaggcctccgtgctggagatcctggtgtacaacagcaagattgagaaccgccacgagatgctggctgtggagcccatcaatgaactgctgcgggacaagtggcgcaagttcggggccgtctccttctacatcaacgtggtctcctacctgtgtgccatggtcatcttcactctcaccgcctactaccagccgctggagggcacaccgccgtacccttaccgcaccacggtggactacctgcggctggctggcgaggtcattacgctcttcactggggtcctgttcttcttcaccaacatcaaagacttgttcatgaagaaatgccctggagtgaattctctcttcattgatggctccttccagctgctctacttcatctactctgtcctggtgatcgtctcagcagccctctacctggcagggatcgaggcctacctggccgtgatggtctttgccctggtcctgggctggatgaatgccctttacttcacccgtgggctgaagctgacggggacctatagcatcatgatccagaagattctcttcaaggaccttttccgattcctgctcgtctacttgctcttcatgatcggctacgcttcagccctggtctccctcctgaacccgtgtgccaacatgaaggtgtgcaatgaggaccagaccaactgcacagtgcccacttacccctcgtgccgtgacagcgagaccttcagcaccttcctcctggacctgtttaagctgaccatcggcatgggcgacctggagatgctgagcagcaccaagtaccccgtggtcttcatcatcctgctggtgacctacatcatcctcacctttgtgctgctcctcaacatgctcattgccctcatgggcgagacagtgggccaggtctccaaggagagcaagcacatctggaagctgcagtgggccaccaccatcctggacattgagcgctccttccccgtattcctgaggaaggccttccgctctggggagatggtcaccgtgggcaagagctcggacggcactcctgaccgcaggtggtgcttcagggtggatgaggtgaactggtctcactggaaccagaacttgggcatcatcaacgaggacccgggcaagaatgagacctaccagtattatggcttctcgcataccgtgggccgcctccgcagggatcgctggtcctcggtggtaccccgcgtggtggaactgaacaagaactcgaacccggacgaggtggtggtgcctctggacagcatggggaacccccgctgcgatggccaccagcagggttacccccgcaagtggaggactgatgacgccccgctctagggactgcagcccagccccagcttctctgcccactcatttctagtccagccgcatttcagcagtgccttctggggtgtccccccacaccctgctttggccccagaggcgagggaccagtggaggtgccagggaggccccaggaccctgtggtcccctggctctgcctccccaccctggggtgggggctcccggccacctgtcttgctcctatggagtcacataagccaacgccagagcccctccacctcaggccccagcccctgcctctccattatttatttgctctgctctcaggaagcgacgtgacccctgccccagctggaacctggcagaggccttaggaccccgttccaagtgcactgcccggccaagccccagcctcagcctgcgcctgagctgcatgcgccaccatttttggcagcgtggcagctttgcaaggggctggggccctcggcgtggggccatgccttctgtgtgttctgtagtgtctgggatttgccggtgctcaataaatgtttattcattgacggtgga

SEQ ID NO: 32212 - DNA, 3058 bp, Homo sapiens
ccggccgggattcaggaagcgcggatctcccggccgccggcgcccagccgtcccggaggctgagcagtgcagacgggcctggggcaggcatggcggattccagcgaaggcccccgcgcggggcccggggaggtggctgagctccccggggatgagagtggcaccccaggtggggaggcttttcctctctcctccctggccaatctgtttgagggggaggatggctccctttcgccctcaccggctgatgccagtcgccctgctggcccaggcgatgggcgaccaaatctgcgcatgaagttccagggcgccttccgcaagggggtgcccaaccccatcgatctgctggagtccaccctatatgagtcctcggtggtgcctgggcccaagaaagcacccatggactcactgtttgactacggcacctatcgtcaccactccagtgacaacaagaggtggaggaagaagatcatagagaagcagccgcagagccccaaagcccctgcccctcagccgccccccatcctcaaagtcttcaaccggcctatcctctttgacatcgtgtcccggggctccactgctgacctggacgggctgctcccattcttgctgacccacaagaaacgcctaactgatgaggagtttcgagagccatctacggggaagacctgcctgcccaaggccttgctgaacctgagcaatggccgcaacgacaccatccctgtgctgctggacatcgcggagcgcaccggcaacatgagggagttcattaactcgcccttccgtgacatctactatcgaggtcagacagccctgcacatcgccattgagcgtcgctgcaaacactacgtggaacttctcgtggcccagggagctgatgtccacgcccaggcccgtgggcgcttcttccagcccaaggatgaggggggctacttctactttggggagctgcccctgtcgctggctgcctgcaccaaccagccccacattgtcaactacctgacggagaacccccacaagaaggcggacatgcggcgccaggactcgcgaggcaacacagtgctgcatgcgctggtggccattgctgacaacacccgtgagaacaccaagtttgttaccaagatgtacgacctgctgctgctcaagtgtgcccgcctcttccccgacagcaacctggaggccgtgctcaacaacgacggcctctcgcccctcatgatggctgccaagacgggcaagattgggaaccgccacgagatgctggctgtggagcccatcaatgaactgctgcgggacaagtggcgcaagttcggggccgtctccttctacatcaacgtggtctcctacctgtgtgccatggtcatcttcactctcaccgcctactaccagccgctggagggcacaccgccgtacccttaccgcaccacggtggactacctgcggctggctggcgaggtcattacgctcttcactggggtcctgttcttcttcaccaacatcaaagacttgttcatgaagaaatgccctggagtgaattctctcttcattgatggctccttccagctgctctacttcatctactctgtcctggtgatcgtctcagcagccctctacctggcagggatcgaggcctacctggccgtgatggtctttgccctggtcctgggctggatgaatgccctttacttcacccgtgggctgaagctgacggggacctatagcatcatgatccagaagattctcttcaaggaccttttccgattcctgctcgtctacttgctcttcatgatcggctacgcttcagccctggtctccctcctgaacccgtgtgccaacatgaaggtgtgcaatgaggaccagaccaactgcacagtgcccacttacccctcgtgccgtgacagcgagaccttcagcaccttcctcctggacctgtttaagctgaccatcggcatgggcgacctggagatgctgagcagcaccaagtaccccgtggtcttcatcatcctgctggtgacctacatcatcctcacctttgtgctgctcctcaacatgctcattgccctcatgggcgagacagtgggccaggtctccaaggagagcaagcacatctggaagctgcagtgggccaccaccatcctggacattgagcgctccttccccgtattcctgaggaaggccttccgctctggggagatggtcaccgtgggcaagagctcggacggcactcctgaccgcaggtggtgcttcagggtggatgaggtgaactggtctcactggaaccagaacttgggcatcatcaacgaggacccgggcaagaatgagacctaccagtattatggcttctcgcataccgtgggccgcctccgcagggatcgctggtcctcggtggtaccccgcgtggtggaactgaacaagaactcgaacccggacgaggtggtggtgcctctggacagcatggggaacccccgctgcgatggccaccagcagggttacccccgcaagtggaggactgatgacgccccgctctagggactgcagcccagccccagcttctctgcccactcatttctagtccagccgcatttcagcagtgccttctggggtgtccccccacaccctgctttggccccagaggcgagggaccagtggaggtgccagggaggccccaggaccctgtggtcccctggctctgcctccccaccctggggtgggggctcccggccacctgtcttgctcctatggagtcacataagccaacgccagagcccctccacctcaggccccagcccctgcctctccattatttatttgctctgctctcaggaagcgacgtgacccctgccccagctggaacctggcagaggccttaggaccccgttccaagtgcactgcccggccaagccccagcctcagcctgcgcctgagctgcatgcgccaccatttttggcagcgtggcagctttgcaaggggctggggccctcggcgtggggccatgccttctgtgtgttctgtagtgtctgggatttgccggtgctcaataaatgtttattcattgacggtgg

SEQ ID NO: 32213 - DNA, 3097 bp, Homo sapiens
ccggccgggattcaggaagcgcggatctcccggccgccggcgcccagccgtcccggaggctgagcagtgcagacgggcctggggcaggcatggcggattccagcgaaggcccccgcgcggggcccggggaggtggctgagctccccggggatgagagtggcaccccaggtggggaggcttttcctctctcctccctggccaatctgtttgagggggaggatggctccctttcgccctcaccggctgatgccagtcgccctgctggcccaggcgatgggcgaccaaatctgcgcatgaagttccagggcgccttccgcaagggggtgcccaaccccatcgatctgctggagtccaccctatatgagtcctcggtggtgcctgggcccaagaaagcacccatggactcactgtttgactacggcacctatcgtcaccactccagtgacaacaagaggtggaggaagaagatcatagagaagcagccgcagagccccaaagcccctgcccctcagccgccccccatcctcaaagtcttcaaccggcctatcctctttgacatcgtgtcccggggctccactgctgacctggacgggctgctcccattcttgctgacccacaagaaacgcctaactgatgaggagtttcgagagccatctacggggaagacctgcctgcccaaggccttgctgaacctgagcaatggccgcaacgacaccatccctgtgctgctggacatcgcggagcgcaccggcaacatgagggagttcattaactcgcccttccgtgacatctactatcgaggggagctgcccctgtcgctggctgcctgcaccaaccagccccacattgtcaactacctgacggagaacccccacaagaaggcggacatgcggcgccaggactcgcgaggcaacacagtgctgcatgcgctggtggccattgctgacaacacccgtgagaacaccaagtttgttaccaagatgtacgacctgctgctgctcaagtgtgcccgcctcttccccgacagcaacctggaggccgtgctcaacaacgacggcctctcgcccctcatgatggctgccaagacgggcaagattgggatctttcagcacatcatccggcgggaggtgacggatgaggacacacggcacctgtcccgcaagttcaaggactgggcctatgggccagtgtattcctcgctttatgacctctcctccctggacacgtgtggggaagaggcctccgtgctggagatcctggtgtacaacagcaagattgagaaccgccacgagatgctggctgtggagcccatcaatgaactgctgcgggacaagtggcgcaagttcggggccgtctccttctacatcaacgtggtctcctacctgtgtgccatggtcatcttcactctcaccgcctactaccagccgctggagggcacaccgccgtacccttaccgcaccacggtggactacctgcggctggctggcgaggtcattacgctcttcactggggtcctgttcttcttcaccaacatcaaagacttgttcatgaagaaatgccctggagtgaattctctcttcattgatggctccttccagctgctctacttcatctactctgtcctggtgatcgtctcagcagccctctacctggcagggatcgaggcctacctggccgtgatggtctttgccctggtcctgggctggatgaatgccctttacttcacccgtgggctgaagctgacggggacctatagcatcatgatccagaagattctcttcaaggaccttttccgattcctgctcgtctacttgctcttcatgatcggctacgcttcagccctggtctccctcctgaacccgtgtgccaacatgaaggtgtgcaatgaggaccagaccaactgcacagtgcccacttacccctcgtgccgtgacagcgagaccttcagcaccttcctcctggacctgtttaagctgaccatcggcatgggcgacctggagatgctgagcagcaccaagtaccccgtggtcttcatcatcctgctggtgacctacatcatcctcacctttgtgctgctcctcaacatgctcattgccctcatgggcgagacagtgggccaggtctccaaggagagcaagcacatctggaagctgcagtgggccaccaccatcctggacattgagcgctccttccccgtattcctgaggaaggccttccgctctggggagatggtcaccgtgggcaagagctcggacggcactcctgaccgcaggtggtgcttcagggtggatgaggtgaactggtctcactggaaccagaacttgggcatcatcaacgaggacccgggcaagaatgagacctaccagtattatggcttctcgcataccgtgggccgcctccgcagggatcgctggtcctcggtggtaccccgcgtggtggaactgaacaagaactcgaacccggacgaggtggtggtgcctctggacagcatggggaacccccgctgcgatggccaccagcagggttacccccgcaagtggaggactgatgacgccccgctctagggactgcagcccagccccagcttctctgcccactcatttctagtccagccgcatttcagcagtgccttctggggtgtccccccacaccctgctttggccccagaggcgagggaccagtggaggtgccagggaggccccaggaccctgtggtcccctggctctgcctccccaccctggggtgggggctcccggccacctgtcttgctcctatggagtcacataagccaacgccagagcccctccacctcaggccccagcccctgcctctccattatttatttgctctgctctcaggaagcgacgtgacccctgccccagctggaacctggcagaggccttaggaccccgttccaagtgcactgcccggccaagccccagcctcagcctgcgcctgagctgcatgcgccaccatttttggcagcgtggcagctttgcaaggggctggggccctcggcgtggggccatgccttctgtgtgttctgtagtgtctgggatttgccggtgctcaataaatgtttattcattgacggtgg

SEQ ID NO: 32214 - DNA, 3247 bp, Homo sapiens
ggggcttcctggagcccccgcccctggccgggttctgcctgactcccctttcattcccttgcaggctgagcagtgcagacgggcctggggcaggcatggcggattccagcgaaggcccccgcgcggggcccggggaggtggctgagctccccggggatgagagtggcaccccaggtggggaggcttttcctctctcctccctggccaatctgtttgagggggaggatggctccctttcgccctcaccggctgatgccagtcgccctgctggcccaggcgatgggcgaccaaatctgcgcatgaagttccagggcgccttccgcaagggggtgcccaaccccatcgatctgctggagtccaccctatatgagtcctcggtggtgcctgggcccaagaaagcacccatggactcactgtttgactacggcacctatcgtcaccactccagtgacaacaagaggtggaggaagaagatcatagagaagcagccgcagagccccaaagcccctgcccctcagccgccccccatcctcaaagtcttcaaccggcctatcctctttgacatcgtgtcccggggctccactgctgacctggacgggctgctcccattcttgctgacccacaagaaacgcctaactgatgaggagtttcgagagccatctacggggaagacctgcctgcccaaggccttgctgaacctgagcaatggccgcaacgacaccatccctgtgctgctggacatcgcggagcgcaccggcaacatgagggagttcattaactcgcccttccgtgacatctactatcgaggtcagacagccctgcacatcgccattgagcgtcgctgcaaacactacgtggaacttctcgtggcccagggagctgatgtccacgcccaggcccgtgggcgcttcttccagcccaaggatgaggggggctacttctactttggggagctgcccctgtcgctggctgcctgcaccaaccagccccacattgtcaactacctgacggagaacccccacaagaaggcggacatgcggcgccaggactcgcgaggcaacacagtgctgcatgcgctggtggccattgctgacaacacccgtgagaacaccaagtttgttaccaagatgtacgacctgctgctgctcaagtgtgcccgcctcttccccgacagcaacctggaggccgtgctcaacaacgacggcctctcgcccctcatgatggctgccaagacgggcaagattgggatctttcagcacatcatccggcgggaggtgacggatgaggacacacggcacctgtcccgcaagttcaaggactgggcctatgggccagtgtattcctcgctttatgacctctcctccctggacacgtgtggggaagaggcctccgtgctggagatcctggtgtacaacagcaagattgagaaccgccacgagatgctggctgtggagcccatcaatgaactgctgcgggacaagtggcgcaagttcggggccgtctccttctacatcaacgtggtctcctacctgtgtgccatggtcatcttcactctcaccgcctactaccagccgctggagggcacaccgccgtacccttaccgcaccacggtggactacctgcggctggctggcgaggtcattacgctcttcactggggtcctgttcttcttcaccaacatcaaagacttgttcatgaagaaatgccctggagtgaattctctcttcattgatggctccttccagctgctctacttcatctactctgtcctggtgatcgtctcagcagccctctacctggcagggatcgaggcctacctggccgtgatggtctttgccctggtcctgggctggatgaatgccctttacttcacccgtgggctgaagctgacggggacctatagcatcatgatccagaagattctcttcaaggaccttttccgattcctgctcgtctacttgctcttcatgatcggctacgcttcagccctggtctccctcctgaacccgtgtgccaacatgaaggtgtgcaatgaggaccagaccaactgcacagtgcccacttacccctcgtgccgtgacagcgagaccttcagcaccttcctcctggacctgtttaagctgaccatcggcatgggcgacctggagatgctgagcagcaccaagtaccccgtggtcttcatcatcctgctggtgacctacatcatcctcacctttgtgctgctcctcaacatgctcattgccctcatgggcgagacagtgggccaggtctccaaggagagcaagcacatctggaagctgcagtgggccaccaccatcctggacattgagcgctccttccccgtattcctgaggaaggccttccgctctggggagatggtcaccgtgggcaagagctcggacggcactcctgaccgcaggtggtgcttcagggtggatgaggtgaactggtctcactggaaccagaacttgggcatcatcaacgaggacccgggcaagaatgagacctaccagtattatggcttctcgcataccgtgggccgcctccgcagggatcgctggtcctcggtggtaccccgcgtggtggaactgaacaagaactcgaacccggacgaggtggtggtgcctctggacagcatggggaacccccgctgcgatggccaccagcagggttacccccgcaagtggaggactgatgacgccccgctctagggactgcagcccagccccagcttctctgcccactcatttctagtccagccgcatttcagcagtgccttctggggtgtccccccacaccctgctttggccccagaggcgagggaccagtggaggtgccagggaggccccaggaccctgtggtcccctggctctgcctccccaccctggggtgggggctcccggccacctgtcttgctcctatggagtcacataagccaacgccagagcccctccacctcaggccccagcccctgcctctccattatttatttgctctgctctcaggaagcgacgtgacccctgccccagctggaacctggcagaggccttaggaccccgttccaagtgcactgcccggccaagccccagcctcagcctgcgcctgagctgcatgcgccaccatttttggcagcgtggcagctttgcaaggggctggggccctcggcgtggggccatgccttctgtgtgttctgtagtgtctgggatttgccggtgctcaataaatgtttattcattgacggtggaga

SEQ ID NO: 32215 - DNA, 2514 bp, Homo sapiens
atggcggattccagcgaaggcccccgcgcggggcccggggaggtggctgagctccccggggatgagagtggcaccccaggcgatgggcgaccaaatctgcgcatgaagttccagggcgccttccgcaagggggtgcccaaccccatcgatctgctggagtccaccctatatgagtcctcggtggtgcctgggcccaagaaagcacccatggactcactgtttgactacggcacctatcgtcaccactccagtgacaacaagaggtggaggaagaagatcatagagaagcagccgcagagccccaaagcccctgcccctcagccgccccccatcctcaaagtcttcaaccggcctatcctctttgacatcgtgtcccggggctccactgctgacctggacgggctgctcccattcttgctgacccacaagaaacgcctaactgatgaggagtttcgagagccatctacggggaagacctgcctgcccaaggccttgctgaacctgagcaatggccgcaacgacaccatccctgtgctgctggacatcgcggagcgcaccggcaacatgagggagttcattaactcgcccttccgtgacatctactatcgaggtcagacagccctgcacatcgccattgagcgtcgctgcaaacactacgtggaacttctcgtggcccagggagctgatgtccacgcccaggcccgtgggcgcttcttccagcccaaggatgaggggggctacttctactttggggagctgcccctgtcgctggctgcctgcaccaaccagccccacattgtcaactacctgacggagaacccccacaagaaggcggacatgcggcgccaggactcgcgaggcaacacagtgctgcatgcgctggtggccattgctgacaacacccgtgagaacaccaagtttgttaccaagatgtacgacctgctgctgctcaagtgtgcccgcctcttccccgacagcaacctggaggccgtgctcaacaacgacggcctctcgcccctcatgatggctgccaagacgggcaagattgggatctttcagcacatcatccggcgggaggtgacggatgaggacacacggcacctgtcccgcaagttcaaggactgggcctatgggccagtgtattcctcgctttatgacctctcctccctggacacgtgtggggaagaggcctccgtgctggagatcctggtgtacaacagcaagattgagaaccgccacgagatgctggctgtggagcccatcaatgaactgctgcgggacaagtggcgcaagttcggggccgtctccttctacatcaacgtggtctcctacctgtgtgccatggtcatcttcactctcaccgcctactaccagccgctggagggcacaccgccgtacccttaccgcaccacggtggactacctgcggctggctggcgaggtcattacgctcttcactggggtcctgttcttcttcaccaacatcaaagacttgttcatgaagaaatgccctggagtgaattctctcttcattgatggctccttccagctgctctacttcatctactctgtcctggtgatcgtctcagcagccctctacctggcagggatcgaggcctacctggccgtgatggtctttgccctggtcctgggctggatgaatgccctttacttcacccgtgggctgaagctgacggggacctatagcatcatgatccagaagattctcttcaaggaccttttccgattcctgctcgtctacttgctcttcatgatcggctacgcttcagccctggtctccctcctgaacccgtgtgccaacatgaaggtgtgcaatgaggaccagaccaactgcacagtgcccacttacccctcgtgccgtgacagcgagaccttcagcaccttcctcctggacctgtttaagctgaccatcggcatgggcgacctggagatgctgagcagcaccaagtaccccgtggtcttcatcatcctgctggtgacctacatcatcctcacctttgtgctgctcctcaacatgctcattgccctcatgggcgagacagtgggccaggtctccaaggagagcaagcacatctggaagctgcagtgggccaccaccatcctggacattgagcgctccttccccgtattcctgaggaaggccttccgctctggggagatggtcaccgtgggcaagagctcggacggcactcctgaccgcaggtggtgcttcagggtggatgaggtgaactggtctcactggaaccagaacttgggcatcatcaacgaggacccgggcaagaatgagacctaccagtattatggcttctcgcataccgtgggccgcctccgcagggatcgctggtcctcggtggtaccccgcgtggtggaactgaacaagaactcgaacccggacgaggtggtggtgcctctggacagcatggggaacccccgctgcgatggccaccagcagggttacccccgcaagtggaggactgatgacgccccgctctag

SEQ ID NO: 32216 - DNA, 2436 bp, Homo sapiens
atggcggattccagcgaaggcccccgcgcggggcccggggaggtggctgagctccccggggatgagagtggcaccccaggtggggaggcttttcctctctcctccctggccaatctgtttgagggggaggatggctccctttcgccctcaccggctgatgccagtcgccctgctggcccaggcgatgggcgaccaaatctgcgcatgaagttccagggcgccttccgcaagggggtgcccaaccccatcgatctgctggagtccaccctatatgagtcctcggtggtgcctgggcccaagaaagcacccatggactcactgtttgactacggcacctatcgtcaccactccagtgacaacaagaggtggaggaagaagatcatagagaagcagccgcagagccccaaagcccctgcccctcagccgccccccatcctcaaagtcttcaaccggcctatcctctttgacatcgtgtcccggggctccactgctgacctggacgggctgctcccattcttgctgacccacaagaaacgcctaactgatgaggagtttcgagagccatctacggggaagacctgcctgcccaaggccttgctgaacctgagcaatggccgcaacgacaccatccctgtgctgctggacatcgcggagcgcaccggcaacatgagggagttcattaactcgcccttccgtgacatctactatcgaggtcagacagccctgcacatcgccattgagcgtcgctgcaaacactacgtggaacttctcgtggcccagggagctgatgtccacgcccaggcccgtgggcgcttcttccagcccaaggatgaggggggctacttctactttggggagctgcccctgtcgctggctgcctgcaccaaccagccccacattgtcaactacctgacggagaacccccacaagaaggcggacatgcggcgccaggactcgcgaggcaacacagtgctgcatgcgctggtggccattgctgacaacacccgtgagaacaccaagtttgttaccaagatgtacgacctgctgctgctcaagtgtgcccgcctcttccccgacagcaacctggaggccgtgctcaacaacgacggcctctcgcccctcatgatggctgccaagacgggcaagattgggaaccgccacgagatgctggctgtggagcccatcaatgaactgctgcgggacaagtggcgcaagttcggggccgtctccttctacatcaacgtggtctcctacctgtgtgccatggtcatcttcactctcaccgcctactaccagccgctggagggcacaccgccgtacccttaccgcaccacggtggactacctgcggctggctggcgaggtcattacgctcttcactggggtcctgttcttcttcaccaacatcaaagacttgttcatgaagaaatgccctggagtgaattctctcttcattgatggctccttccagctgctctacttcatctactctgtcctggtgatcgtctcagcagccctctacctggcagggatcgaggcctacctggccgtgatggtctttgccctggtcctgggctggatgaatgccctttacttcacccgtgggctgaagctgacggggacctatagcatcatgatccagaagattctcttcaaggaccttttccgattcctgctcgtctacttgctcttcatgatcggctacgcttcagccctggtctccctcctgaacccgtgtgccaacatgaaggtgtgcaatgaggaccagaccaactgcacagtgcccacttacccctcgtgccgtgacagcgagaccttcagcaccttcctcctggacctgtttaagctgaccatcggcatgggcgacctggagatgctgagcagcaccaagtaccccgtggtcttcatcatcctgctggtgacctacatcatcctcacctttgtgctgctcctcaacatgctcattgccctcatgggcgagacagtgggccaggtctccaaggagagcaagcacatctggaagctgcagtgggccaccaccatcctggacattgagcgctccttccccgtattcctgaggaaggccttccgctctggggagatggtcaccgtgggcaagagctcggacggcactcctgaccgcaggtggtgcttcagggtggatgaggtgaactggtctcactggaaccagaacttgggcatcatcaacgaggacccgggcaagaatgagacctaccagtattatggcttctcgcataccgtgggccgcctccgcagggatcgctggtcctcggtggtaccccgcgtggtggaactgaacaagaactcgaacccggacgaggtggtggtgcctctggacagcatggggaacccccgctgcgatggccaccagcagggttacccccgcaagtggaggactgatgacgccccgctctag

SEQ ID NO: 32217 - DNA, 2475 bp, Homo sapiens
atggcggattccagcgaaggcccccgcgcggggcccggggaggtggctgagctccccggggatgagagtggcaccccaggtggggaggcttttcctctctcctccctggccaatctgtttgagggggaggatggctccctttcgccctcaccggctgatgccagtcgccctgctggcccaggcgatgggcgaccaaatctgcgcatgaagttccagggcgccttccgcaagggggtgcccaaccccatcgatctgctggagtccaccctatatgagtcctcggtggtgcctgggcccaagaaagcacccatggactcactgtttgactacggcacctatcgtcaccactccagtgacaacaagaggtggaggaagaagatcatagagaagcagccgcagagccccaaagcccctgcccctcagccgccccccatcctcaaagtcttcaaccggcctatcctctttgacatcgtgtcccggggctccactgctgacctggacgggctgctcccattcttgctgacccacaagaaacgcctaactgatgaggagtttcgagagccatctacggggaagacctgcctgcccaaggccttgctgaacctgagcaatggccgcaacgacaccatccctgtgctgctggacatcgcggagcgcaccggcaacatgagggagttcattaactcgcccttccgtgacatctactatcgaggggagctgcccctgtcgctggctgcctgcaccaaccagccccacattgtcaactacctgacggagaacccccacaagaaggcggacatgcggcgccaggactcgcgaggcaacacagtgctgcatgcgctggtggccattgctgacaacacccgtgagaacaccaagtttgttaccaagatgtacgacctgctgctgctcaagtgtgcccgcctcttccccgacagcaacctggaggccgtgctcaacaacgacggcctctcgcccctcatgatggctgccaagacgggcaagattgggatctttcagcacatcatccggcgggaggtgacggatgaggacacacggcacctgtcccgcaagttcaaggactgggcctatgggccagtgtattcctcgctttatgacctctcctccctggacacgtgtggggaagaggcctccgtgctggagatcctggtgtacaacagcaagattgagaaccgccacgagatgctggctgtggagcccatcaatgaactgctgcgggacaagtggcgcaagttcggggccgtctccttctacatcaacgtggtctcctacctgtgtgccatggtcatcttcactctcaccgcctactaccagccgctggagggcacaccgccgtacccttaccgcaccacggtggactacctgcggctggctggcgaggtcattacgctcttcactggggtcctgttcttcttcaccaacatcaaagacttgttcatgaagaaatgccctggagtgaattctctcttcattgatggctccttccagctgctctacttcatctactctgtcctggtgatcgtctcagcagccctctacctggcagggatcgaggcctacctggccgtgatggtctttgccctggtcctgggctggatgaatgccctttacttcacccgtgggctgaagctgacggggacctatagcatcatgatccagaagattctcttcaaggaccttttccgattcctgctcgtctacttgctcttcatgatcggctacgcttcagccctggtctccctcctgaacccgtgtgccaacatgaaggtgtgcaatgaggaccagaccaactgcacagtgcccacttacccctcgtgccgtgacagcgagaccttcagcaccttcctcctggacctgtttaagctgaccatcggcatgggcgacctggagatgctgagcagcaccaagtaccccgtggtcttcatcatcctgctggtgacctacatcatcctcacctttgtgctgctcctcaacatgctcattgccctcatgggcgagacagtgggccaggtctccaaggagagcaagcacatctggaagctgcagtgggccaccaccatcctggacattgagcgctccttccccgtattcctgaggaaggccttccgctctggggagatggtcaccgtgggcaagagctcggacggcactcctgaccgcaggtggtgcttcagggtggatgaggtgaactggtctcactggaaccagaacttgggcatcatcaacgaggacccgggcaagaatgagacctaccagtattatggcttctcgcataccgtgggccgcctccgcagggatcgctggtcctcggtggtaccccgcgtggtggaactgaacaagaactcgaacccggacgaggtggtggtgcctctggacagcatggggaacccccgctgcgatggccaccagcagggttacccccgcaagtggaggactgatgacgccccgctctag

SEQ ID NO: 32218 - DNA, 2295 bp, Homo sapiens
atggcggattccagcgaaggcccccgcgcggggcccggggaggtggctgagctccccggggatgagagtggcaccccaggtggggaggcttttcctctctcctccctggccaatctgtttgagggggaggatggctccctttcgccctcaccggctgatgccagtcgccctgctggcccaggcgatgggcgaccaaatctgcgcatgaagttccagggcgccttccgcaagggggtgcccaaccccatcgatctgctggagtccaccctatatgagtcctcggtggtgcctgggcccaagaaagcacccatggactcactgtttgactacggcacctatcgtcaccactccagtgacaacaagaggtggaggaagaagatcatagagaagcagccgcagagccccaaagcccctgcccctcagccgccccccatcctcaaagtcttcaaccggcctatcctctttgacatcgtgtcccggggctccactgctgacctggacgggctgctcccattcttgctgacccacaagaaacgcctaactgatgaggagtttcgagagccatctacggggaagacctgcctgcccaaggccttgctgaacctgagcaatggccgcaacgacaccatccctgtgctgctggacatcgcggagcgcaccggcaacatgagggagttcattaactcgcccttccgtgacatctactatcgaggggagctgcccctgtcgctggctgcctgcaccaaccagccccacattgtcaactacctgacggagaacccccacaagaaggcggacatgcggcgccaggactcgcgaggcaacacagtgctgcatgcgctggtggccattgctgacaacacccgtgagaacaccaagtttgttaccaagatgtacgacctgctgctgctcaagtgtgcccgcctcttccccgacagcaacctggaggccgtgctcaacaacgacggcctctcgcccctcatgatggctgccaagacgggcaagattgggaaccgccacgagatgctggctgtggagcccatcaatgaactgctgcgggacaagtggcgcaagttcggggccgtctccttctacatcaacgtggtctcctacctgtgtgccatggtcatcttcactctcaccgcctactaccagccgctggagggcacaccgccgtacccttaccgcaccacggtggactacctgcggctggctggcgaggtcattacgctcttcactggggtcctgttcttcttcaccaacatcaaagacttgttcatgaagaaatgccctggagtgaattctctcttcattgatggctccttccagctgctctacttcatctactctgtcctggtgatcgtctcagcagccctctacctggcagggatcgaggcctacctggccgtgatggtctttgccctggtcctgggctggatgaatgccctttacttcacccgtgggctgaagctgacggggacctatagcatcatgatccagaagattctcttcaaggaccttttccgattcctgctcgtctacttgctcttcatgatcggctacgcttcagccctggtctccctcctgaacccgtgtgccaacatgaaggtgtgcaatgaggaccagaccaactgcacagtgcccacttacccctcgtgccgtgacagcgagaccttcagcaccttcctcctggacctgtttaagctgaccatcggcatgggcgacctggagatgctgagcagcaccaagtaccccgtggtcttcatcatcctgctggtgacctacatcatcctcacctttgtgctgctcctcaacatgctcattgccctcatgggcgagacagtgggccaggtctccaaggagagcaagcacatctggaagctgcagtgggccaccaccatcctggacattgagcgctccttccccgtattcctgaggaaggccttccgctctggggagatggtcaccgtgggcaagagctcggacggcactcctgaccgcaggtggtgcttcagggtggatgaggtgaactggtctcactggaaccagaacttgggcatcatcaacgaggacccgggcaagaatgagacctaccagtattatggcttctcgcataccgtgggccgcctccgcagggatcgctggtcctcggtggtaccccgcgtggtggaactgaacaagaactcgaacccggacgaggtggtggtgcctctggacagcatggggaacccccgctgcgatggccaccagcagggttacccccgcaagtggaggactgatgacgccccgctctag

SEQ ID NO: 32219 - DNA, 2952 bp, Homo sapiens
ctcagctctgcaaagagctcctccccctccaggaaaagcacttctccccaggcagggcggtcagtcccctcagcgcacctgcatgcacacacaccacctcacaaccacacactgcatgcacacacatacaccacagccacacactgtgcatacacgcacaccccacaacccacatactgcatgcacacacacacacctacaagctgcatgctgcatacacaagtcatacaggagataaactcagagtcccagccccaaatagaccccatctcttgctcagttgctgtcatcctagacctgtttctttcgccacatttctataatctgccagtgtctgcaaggagaagacatggggggttttctacctaaggcagaagggcccgggagccaactccagaaacttctgccctcctttctggtcagagaacaagactgggaccagcacctggacaagcttcatatgctgcagcagaagaggattctagagtctccactgcttcgagcatccaaggaaaatgacctgtctgttcttaggcaacttctactggactgcacctgtgacgttcgacaaagaggagccctgggggagacggcgctgcacatagcagccctctatgacaacttggaggcggccttggtgctgatggaggctgccccagagctggtctttgagcccaccacatgtgaggcttttgcaggtcagactgcactgcacatcgctgttgtgaaccagaatgtgaacctggtgcgtgccctgctcacccgcagggccagtgtctctgccagagccacaggcactgccttccgccgtagtccccgcaacctcatctactttggggagcaccctttgtcctttgctgcctgtgtgaacagcgaggagatcgtgcggctgctcattgagcatggagctgacatcagggcccaggactccctgggaaacacagtattacacatcctcatcctccagcccaacaaaacctttgcctgccagatgtacaacctgctgctgtcctacgatggacatggggaccacctgcagcccctggaccttgtgcccaatcaccagggtctcacccccttcaagctggctggagtggagggtaacactgtgatgttccagcacctgatgcagaagcggaggcacatccagtggacgtatggacccctgacctccattctctacgacctcacagagatcgactcctggggagaggagctgtccttcctggagcttgtggtctcctctgataaacgagaggctcgccaaattctggaacagaccccagtgaaggagctggtgagcttcaagtggaacaagtatggccggccgtacttctgcatcctggctgccttgtacctgctctacatgatctgctttaccacgtgctgcgtctaccgcccccttaagtttcgtggtggcaaccgcactcattctcgagacatcaccatcctccagcaaaaactactacaggaggcctatgagacacgtgaagatatcatcaggctggtgggggagctggtgagcatcgttggggctgtgatcatcctgctcctagagattccagacatcttcagggttggtgcctctcgctattttggaaagacgattcttggggggccattccatgtcatcatcatcacctatgcctccctggtgctggtgaccatggtgatgcggctcaccaacaccaatggggaggtggtgcccatgtcctttgccctggtgctgggctggtgcagtgtcatgtatttcactcgaggattccagatgctgggtcccttcaccatcatgatccagaagatgatttttggagacctaatgcgtttctgctggctgatggctgtggtcatcttgggatttgcctccgcgttctatatcattttccagacagaggacccaaccagtctggggcaattctatgactaccccatggcactgttcaccacctttgagctttttctcactgttattgatgcacctgccaactacgacgtggacttgcccttcatgttcagcattgtcaacttcgccttcgccatcattgccacactgctcatgctcaacttgttcatcgccatgatgggcgacacccactggagggtggcccaggagagggatgagctctggagggcccaggtcgtggccaccacagtgatgctggagcggaagctgcctcgctgcctgtggcctcgctccgggatctgtgggtgcgaattcgggctgggggaccgctggttcctgcgggttgagaaccacaatgatcagaatcctctgcgagtgcttcgctatgtggaagtgttcaagaactcagacaaggaggatgaccaggagcatccatctgagaaacagccctctggggctgagagtgggactctagccagagcctctttggctcttccaacttcctccctgtcccggaccgcgtcccagagcagcagtcaccgaggctgggagatccttcgtcaaaacaccctggggcacttgaatcttggactgaaccttagtgagggggatggagaggaggtctaccatttttgattaacatcgctatcactcttgaccttactcccggttggcctgggggcggggacagagacggagacctctgcctatgcaagtgtctaacttctgtgcctgttaatcatgggagggtgagacagaacaatccctaaagggtcatgcctcacacttcacatcagaatttctggcaatgggcaatggtcatcgattgtctcacgtattttctgggctcttgcaagtcacccatctcaggaaaaaggaggttggcaactaaagacatgaggcagggatgctagattaatgtcaggaccatttctcttctgccccacgcagcccctagaaagtagtaagctgtgaggctattctggctccccagggcttacgtgggaagagccaggcatggcatagaggttgtggcccttctttttttc

SEQ ID NO: 32220 - DNA, 2120 bp, Homo sapiens
cacacacaccacctcacaaccacacactgcatgcacacacatacaccacagccacacactgtgcatacacgcacaccccacaacccacatactgcatgcacacacacacacctacaagctgcatgctgcatacacaagtcatacaggagataaactcagagtcccagccccaaatagaccccatctcttgctcagttgctgtcatcctagacctgtttctttcgccacatttctataatctgccagtgtctgcaaggagaagacatggggggttttctacctaaggcagaagggcccgggagccaactccagaaacttctgccctcctttctggtcagagaacaagactgggaccagcacctggacaagcttcatatgctgcagcagaagaggattctagagtctccactgcttcgagcatccaaggaaaatgacctgtctgttcttaggcaacttctactggactgcacctgtgacgttcgacaaagaggagccctgggggagacggcgctgcacatagcagccctctatgacaacttggaggcggccttggtgctgatggaggctgccccagagctggtctttgagcccaccacatgtgaggcttttgcaggtcagactgcactgcacatcgctgttgtgaaccagaatgtgaacctggtgcgtgccctgctcacccgcagggccagtgtctctgccagagccacaggcactgccttccgccgtagtccccgcaacctcatctactttggggagcaccctttgtcctttgctgcctgtgtgaacagcgaggagatcgtgcggctgctcattgagcatggagctgacatcagggcccaggactccctgggaaacacagtattacacatcctcatcctccagcccaacaaaacctttgcctgccagatgtacaacctgctgctgtcctacgatggacatggggaccacctgcagcccctggaccttgtgcccaatcaccagggtctcacccccttcaagctggctggagtggagggtaacactgtgatgttccagcacctgatgcagaagcggaggcacatccagtggacgtatggacccctgacctccattctctacgacctcacagagatcgactcctggggagaggagctgtccttcctggagcttgtggtctcctctgataaacgagaggctcgccaaattctggaacagaccccagtgaaggagctggtgagcttcaagtggaacaagtatggccggccgtacttctgcatcctggctgccttgtacctgctctacatgatctgctttaccacgtgctgcgtctaccgcccccttaagtttcgtggtggcaaccgcactcattctcgagacatcaccatcctccagcaaaaactactacaggtgattctcctcagaaggggatgagagagaattgcatcaaggggtgatggtgctggaaacgaagccatgctactcagggacgatgccacgctctgggttccagcaggtgtaggctcctaaacacccaggtagaaattagacatgagaccaggaggccacagatggggtttaatgagcacaagagcatttgtccagggagctgtggattttctcacacaaactttgaaagagtgcttggcatgagtaagcctgtgcttttgtgaaattttttggtaatttacaaaaagtatcagggttttgtagtgggatgttcaaggtaaactctattgctcaaaaggaggaaaattgtgctccaagtccatttctgagtccatttttgttgtatttgggcaacacagacagccctgctggcctgcaccctcttctgtgtgctgtctatatgggcccatgggaataatgtgtcagctgtctgactgcctgtcagacactctgcagaaggatgtctggattgggtatcaggctgaagtaaatactctctgaggctccatttagtgttgtgggcctgccattctgtgttgtggtggccaagggaaaactagggttaggaagaggactgattcgaggtacacagtaaatatagaaatctgctgttgaagaaagtaaacctcctttttgtgcaacagaaagggtagactctaatgagcacttctgaatatatatatttaacaactgta

SEQ ID NO: 32221 - DNA, 2174 bp, Homo sapiens
atgggtttgtcactgcccaaggagaaagggctaattctctgcctatggagcaagttctgcagatggttccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacgagcccccgggacaacaccctcttacagcagaagctacttcaggaagcctacatgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccagattgtggccaccacggtgatgctggagcggaagctgcctcgctgcctgtggcctcgctccgggatctgcggacgggagtatggcctgggagaccgctggttcctgcgggtggaagacaggcaagatctcaaccggcagcggatccaacgctacgcacaggccttccacacccggggctctgaggatttggacaaagactcagtggaaaaactagagctgggctgtcccttcagcccccacctgtcccttcctatgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccaggccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcggatccctg

SEQ ID NO: 32222 - DNA, 2928 bp, Homo sapiens
agacaggccagccctgcagagtcctggctggctctgccaagtgtaacaaactcacagccctctccaaactggctggggctgctgggagactcccaaggaactcgtcaggaaggcaggagacaggagacgggacctctacagggagacggtgggccggcccttgggggggctgatgtgtccccaaggctgagtcccgtcagggtctggcctcggcctcaggcccccaaggagccggccctacaccccatgggtttgtcactgcccaaggagaaagggctaattctctgcctatggagcaagttctgcagatggttccagagacgggagtcctgggcccagagccgagatgagcagaacctgctgcagcagaagaggatctgggagtctcctctccttctagctgccaaagataatgatgtccaggccctgaacaagttgctcaagtatgaggattgcaaggtgcaccagagaggagccatgggggaaacagcgctacacatagcagccctctatgacaacctggaggccgccatggtgctgatggaggctgccccggagctggtctttgagcccatgacatctgagctctatgagggtcagactgcactgcacatcgctgttgtgaaccagaacatgaacctggtgcgagccctgcttgcccgcagggccagtgtctctgccagagccacaggcactgccttccgccgtagtccctgcaacctcatctactttggggagcaccctttgtcctttgctgcctgtgtgaacagtgaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacgagcccccgggacaacaccctcttacagcagaagctacttcaggaagcctacatgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccagattgtggccaccacggtgatgctggagcggaagctgcctcgctgcctgtggcctcgctccgggatctgcggacgggagtatggcctgggagaccgctggttcctgcgggtggaagacaggcaagatctcaaccggcagcggatccaacgctacgcacaggccttccacacccggggctctgaggatttggacaaagactcagtggaaaaactagagctgggctgtcccttcagcccccacctgtcccttcctatgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccaggccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcggatccctgccca

SEQ ID NO: 32223 - DNA, 407 bp, Homo sapiens
gcaaagcccctcattttggcagaacttaccatgtcgaccagccgcaaattaaagagtcatggcatgaggaggagcaagagccgatctcctcacaagggagtcaagagaggtggcagcaaaagaaaataccgtaagggcaacctgaaaagtaggaaacggggcgatgacgccaatcgcaattaccgctcccacttgtgagcccccagcgggctctgccctggtgcgcttcacacagcaccaagcagcaacaagaacagcagaaggggaactgccaaggagacctgatgttagatcaaagccagagaggagcctatggaatgtggatcaaatgccagttgtgacgaaatgaggaatgtatatgttggctgtttttccccaacatctcaataaaactttgaaagcagaaa

SEQ ID NO: 32224 - DNA, 626 bp, Homo sapiens
ggcctctgtaaagctaggcctgctgggagaggatgaggaggaggccctgcccctccaaacgtggcctcctatggacacccagactcacagccttcctatcacccacactcagctccatagcaactctcagccccaaagccgcacctgcacccgccattgccaaaccttcagccagagttgcagacagagccatcgtggcagccggagccagagctccagccagagcccggccagccaccgcaacccaactggagcccacagctcatccggccaccagagccagagtcccaacactagtccaccaccaaagcgccacaaaaagactatgaactcccaccactctcccatgcggcccaccatcctgcactgccgctgccccaagaacagaaagaacttggaaggcaagctgaaaaagaaaaaaatggccaagaggatccagcaggtgtacaaaaccaagacgcggagctcaggatggaaatccaactaatgagaccgcactccttggcttgttcctgcgtgtttcacccaaaggagaaaatgctaggatgaagtcaatcttcttgcaggaacatgttactatggtgatttctacgcaacactaattaaagcttgtacctggaagacta

SEQ ID NO: 32225 - DNA, 2008 bp, Homo sapiens
ctcggcagccgcctgtcgccgcgggagcagccgctatctctgtgtgtccgcgtgtgcgcccggtccccgcctgccgcaccatggagagacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttg

SEQ ID NO: 32226 - DNA, 1931 bp, Homo sapiens
cgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttgtgggatggcctacaccggcaaatacttcgacaaggccagctaccgagtctattgcttgctgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttg

SEQ ID NO: 32227 - DNA, 2831 bp, Homo sapiens
gggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcggccagtgcaggttctggggaagaagcgtggagggtgcgctagggaggctggtgtccttggtcctgggccaggacctgggtgtcccaagtccccttggaatcacctgcaactgccctcaacctccagaactatcgctgcctcccattcatcaccaggtgacatttgactgcaacctgccttctagctgagaggctgagacctacatccctcattgtgacctcagtccacctggccctgagcgggctggggaactgcctcagtctggaagctgaccaggcactctcagggccgccccacctcccccaagtccccacagccttgcagtcaggtctcctgggatagggaggttcacttgcttgttgtccctcgtccttgtcatatccttttaactaggcatctcagagaagcagagacagggcagccttcgtcctgggggaaaagggaccctcaggatggcatgagaggtcctcaatcccaagtgtggaactgtccccctcaacttgttaaaatgcagatttctgggtcttgccaatggggcctgggactccatgtgacaactggcccaggagcttctgatgtcacacagaattctgcagtcccaagctccagccccgacctgctctgctgttcctaggtgactgccctcacactgctgaccacagtggatttctccccctgctgctcgggctcagctggggtcagccctgcttataaggtcaactgtgcaaaaccttatactggccaagaacaaactagtgctgggggaggagggctgggtgccccggccactggtggagtccccaggaaatcctcagagctgttgcgaggatgagacacatttgtggacacgtccacctgtcctcctgaccgtctggagagaataaacctgtcaaagcc

SEQ ID NO: 32228 - DNA, 3010 bp, Homo sapiens
gcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaattggccctgaaatgttttcttttttgatgtgtttgcagccagtgcaggttctggggaagaagcgtggagggtgcgctagggaggctggtgtccttggtcctgggccaggacctgggtgtcccaagtccccttggaatcacctgcaactgccctcaacctccagaactatcgctgcctcccattcatcaccaggtgacatttgactgcaacctgccttctagctgagaggctgagacctacatccctcattgtgacctcagtccacctggccctgagcgggctggggaactgcctcagtctggaagctgaccaggcactctcagggccgccccacctcccccaagtccccacagccttgcagtcaggtctcctgggatagggaggttcacttgcttgttgtccctcgtccttgtcatatccttttaactaggcatctcagagaagcagagacagggcagccttcgtcctgggggaaaagggaccctcaggatggcatgagaggtcctcaatcccaagtgtggaactgtccccctcaacttgttaaaatgcagatttctgggtcttgccaatggggcctgggactccatgtgacaactggcccaggagcttctgatgtcacacagaattctgcagtcccaagctccagccccgacctgctctgctgttcctaggtgactgccctcacactgctgaccacagtggatttctccccctgctgctcgggctcagctggggtcagccctgcttataaggtcaactgtgcaaaaccttatactggccaagaacaaactagtgctgggggaggagggctgggtgccccggccactggtggagtccccaggaaatcctcagagctgttgcgaggatgagacacatttgtggacacgtccacctgtcctcctgaccgtctggagagaataaacctgtcaaagccaaggtca

SEQ ID NO: 32229 - DNA, 2075 bp, Homo sapiens
ctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagcctcccgagtagctgggactacagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgag

SEQ ID NO: 32230 - DNA, 1278 bp, Homo sapiens
ttcgctcttcagacgccggagacgtaggagtgggtcttcagactccaaaggggttggactaatggcggatgctgaggcgagggctgagttcccggaggaggccagacctgacaggggcaccttgcaggtgttgcaagatatggccagccgcttgcgaatccattccatcagggccacatgctccacgagctccggccaccctacatcatgtagcagttcttctgagatcatgtctgtgctgttcttctacatcatgaggtacaagcagtcagatccagagaatccggacaacgaccgatttgtcctcgcaaagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtgacgatggtgcttcccagatggccctggaggatatagccatgttccgaaccattcccaagtgcacgatcttctacccaactgatgccgtctccacggagcatgctgttgctctggcagccaatgccaaggggatgtgcttcattcggaccacccgaccagaaactatggttatttacaccccacaagaacgctttgagatcggacaggccaaggtcctccgccactgtgtcagtgacaaggtcacagttattggagctggaattactgtgtatgaagccttagcagctgctgatgagctttcgaaacaagatatttttatccgtgtcatcgacctgtttaccattaaacctctggatgtcgccaccatcgtctccagtgcaaaagccacagagggccggatcattacagtggaggatcactacccgcaaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccct

SEQ ID NO: 32231 - DNA, 2642 bp, Homo sapiens
agatcccttgacttgcttgcggagggagcggccggcggagggagcggcaggtggagggagtggcacgaggcatgcggagggagctgcaccgacatcacataaacgcactgggcagctcgcaggcgccattcgctcttcagacgccggagacgtaggagtgggtcttcagactccaaaggggttggactaatggcggatgctgaggcgagggctgagttcccggaggaggccagacctgacaggggcaccttgcaggtgttgcaagatatggccagccgcttgcgaatccattccatcagggccacatgctccacgagctccggccaccctacatcatgtagcagttcttctgagatcatgtctgtgctgttcttctacatcatgaggtacaagcagtcagatccagagaatccggacaacgaccgatttgtcctcgcaaagagactgtcgtttgtggatgtggcaacaggatggctcggacaaggactgggagttgcatgtggaatggcatatactggcaagtacttcgacagggccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtggaacacttatgtggtggacggccgggacgtggaggcactgtgccaggtattctggcaggcttctcaggtgaagcacaagcccactgctgtggtggccaagaccttcaagggccggggcaccccaagtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtgacgatggtgcttcccagatggccctggaggatatagccatgttccgaaccattcccaagtgcacgatcttctacccaactgatgccgtctccacggagcatgctgttgctctggcagccaatgccaaggggatgtgcttcattcggaccacccgaccagaaactatggttatttacaccccacaagaacgctttgagatcggacaggccaaggtcctccgccactgtgtcagtgacaaggtcacagttattggagctggaattactgtgtatgaagccttagcagctgctgatgagctttcgaaacaagatatttttatccgtgtcatcgacctgtttaccattaaacctctggatgtcgccaccatcgtctccagtgcaaaagccacagagggccggatcattacagtggaggatcactacccgcaaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaacca

SEQ ID NO: 32232 - DNA, 2703 bp, Homo sapiens
tcccttgacttgcttgcggagggagcggccggcggagggagcggcaggtggagggagtggcacgaggcatgcggagggagctgcaccgacatcacataaacgcactgggcagctcgcaggcgccattcgctcttcagacgccggagacgtaggagtgggtcttcagactccaaaggggttggactaatggcggatgctgaggcgagggctgagttcccggaggaggccagacctgacaggggcaccttgcaggtgttgcaagatatggccagccgcttgcgaatccattccatcagggccacatgctccacgagctccggccaccctacatcatgtagcagttcttctgagatcatgtctgtgctgttcttctacatcatgaggtacaagcagtcagatccagagaatccggacaacgaccgatttgtcctcgcaaagagactgtcgtttgtggatgtggcaacaggatggctcggacaaggactgggagttgcatgtggaatggcatatactggcaagtacttcgacagggccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtggaacacttatgtggtggacggccgggacgtggaggcactgtgccaggtattctggcaggcttctcaggtgaagcacaagcccactgctgtggtggccaagaccttcaagggccggggcaccccaagtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtgacgatggtgcttcccagatggccctggaggatatagccatgttccgaaccattcccaagtgcacgatcttctacccaactgatgccgtctccacggagcatgctgttgctctggcagccaatgccaaggggatgtgcttcattcggaccacccgaccagaaactatggttatttacaccccacaagaacgctttgagatcggacaggccaagggcgtatccatgctccaggacagctggagcagtgtaatttcctatcaaaaagtcctccgccactgtgtcagtgacaaggtcacagttattggagctggaattactgtgtatgaagccttagcagctgctgatgagctttcgaaacaagatatttttatccgtgtcatcgacctgtttaccattaaacctctggatgtcgccaccatcgtctccagtgcaaaagccacagagggccggatcattacagtggaggatcactacccgcaaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaaccagctgctttattca

SEQ ID NO: 32233 - DNA, 2566 bp, Homo sapiens
aaacttgccccgagtccacggtgctctgcggttaggagctggcctcactgtgcacagggggaggggtggtgagcttaccgggctttaaagcgcccttccaacctgtgagccctgcattccttacccttggttggattcttcccgggctgggagaaatgaccgcttctatgaggagaccatgtgccgaggtcgtgtgctaggaagccagttgctgtgagaaatgaccagtgtcatgtctgtctttcagccaccctacatcatgtagcagttcttctgagatcatgtctgtgctgttcttctacatcatgaggtacaagcagtcagatccagagaatccggacaacgaccgatttgtcctcgcaaagagactgtcgtttgtggatgtggcaacaggatggctcggacaaggactgggagttgcatgtggaatggcatatactggcaagtacttcgacagggccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtggaacacttatgtggtggacggccgggacgtggaggcactgtgccaggtattctggcaggcttctcaggtgaagcacaagcccactgctgtggtggccaagaccttcaagggccggggcaccccaagtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtgacgatggtgcttcccagatggccctggaggatatagccatgttccgaaccattcccaagtgcacgatcttctacccaactgatgccgtctccacggagcatgctgttgctctggcagccaatgccaaggggatgtgcttcattcggaccacccgaccagaaactatggttatttacaccccacaagaacgctttgagatcggacaggccaaggtcctccgccactgtgtcagtgacaaggtcacagttattggagctggaattactgtgtatgaagccttagcagctgctgatgagctttcgaaacaagatatttttatccgtgtcatcgacctgtttaccattaaacctctggatgtcgccaccatcgtctccagtgcaaaagccacagagggccggatcattacagtggaggatcactacccgcaaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaacca

SEQ ID NO: 32234 - DNA, 1468 bp, Homo sapiens
gtgctacgccatcaagggcccccagtcccgggtgccgcggggacagtgtagggtcattagctgttgagccgccccgggcgggcccaagcctttggatctcaggtgaccggcacaggcggccgcggggtccggaactgcttgttccggcagtggaagagacgcgccggcgttggccgctgctgctagcagcttgaaccccagggtcgggaccgatgtcggcttgggctgctgccagcctaagcagggccgctgcccgatgcttgctggcacgaggccccggggtcagggcggctcctccgcgcgacccccggccctcccaccccgagccccggggctgcggtgccgctccgggcaggacgctgcactttaccgcggctgtccccgccgggcacaacaagtggtccaaagtcaggcacatcaagggtccgaaggacgtcgaaaggagtcgcatcttctccaaactctgtttgaacatccgcctggcagtgaaagaaggaggccccaaccctgagcacaacagcaacctggccaatatcttagaggtgtgtcgcagcaaacatatgcccaagtcaacgattgagacagcactgaaaatggagaaatccaaggacacttatttgctgtatgagggtcgaggccctggtggctcttctctgctcatcgaggcattatctaacagtagccacaagtgccaagcagacattagacatatcctgaataagaatggaggagtgatggctgtaggagctcgtcactcttttgacaaaaagggggtgattgtggttgaagtggaggacagagagaagaaggctgtgaacctagagcgtgccctggagatggcaatcgaagcaggagctgaggatgtcaaggaaactgaagatgaagaagaaaggaacgtttttaaatttatttgtgatgcctcttcactgcaccaagtgaggaagaagctggactccctgggcctgtgttctgtgtcctgtgcactagagttcatccccaactcaaaggtgcagctggctgagcccgacctggaacaggccgcacatctcattcaggctctcagcaaccacgaggatgtgattcacgtctatgataacattgaataaccaggctacatgtgcccccgggttccttcctagaaatgtggcagcccattccagcacacaggcttctgcagcaatctctgagggtaaagccggtgggaggctcagcaggccaggaggcccaaggacaggacttgcgaccttgaagccaaaggaatctcacttgtggggcctccttgtcagctctgctgctgtctcagagccatctggatgagtgtcccgacaccctctcggatgcagggcaggaccacccagctggtcagactctgatgttgggtagctggcctctgtggggattgtaagtgccctgaggcgctctgtactagaaactgctcttaataataacggtgattattggttgctgc

SEQ ID NO: 32235 - DNA, 3420 bp, Homo sapiens
cctctcctctgccctttggacgcgcgcctcggttccgaacgcagcggacggcgcctcaggcagcgcggcggacagcccgtcctccggcgcgccgcgagcctcggaggaccctagcgacggtcgtggcgtaagaccggggggacgcggcggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagaggaaatcagaaaagttgtacagagtttagaacaaacagctcgagagattttaactctactgcaaggggtccatcagggtgctgggtttcaggacattccaaagaggtgtttgaaagctcgagaacattttggtacagtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcattgagccagatcgggagaaaggatttcatctggatgtagaagattatctctcaggagttctaattcttgccagtgaactgtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgtaagtgagtgtgctgctgtaagaaatctcccatgtgcataacaaattctgaatattttttgaggctaaagaagaccggggtgacaagcagatactgctgtgtaatggttacactaaccaaaagacaccagccactcagagttctatactgtaaagcgcagataacatttgtgtgttataccttgattggggaattaaaagtcatttaactgaagatgttgagaaacctgggctctggttttagtataccggaattacttttttccaattttagaaaatcaagcaggttagagaaaatagagatgaattaggggacactgtcttatggattcatttataagaagagaaccagccatatacacttggggagatttgccacatcttaaacttgaataatagtatgagtaatgcttaagggagtttaatagagaaggaaagctttggcagtgttttgagaacttaagtggctaaagagatgagacaaacatgcaggtcgctactggcatagtttcataattgtgtactcggaaattaaagtttgcttgtttcttggtctggattaaa

SEQ ID NO: 32236 - DNA, 1089 bp, Homo sapiens
agcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatcccaaagaggtgtttgaaagctcgagaacattttggtacagtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcattgagccagatcgggagaaaggatttcatctggatgtagaagattatctctcaggagttctaattcttgccagtgaactgtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcct

SEQ ID NO: 32237 - DNA, 1088 bp, Homo sapiens
ggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagaggaaatcagaaaagttgtacagagtttagaacaaacagctcgagagattttaactctactgcaaggggtccatcagggtgctgggtttcaggacattccaaagaggtgtttgaaagctcgagaacattttggtacagtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcatcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagt

SEQ ID NO: 32238 - DNA, 2762 bp, Homo sapiens
gcggccgcaatagtacgctcgcgcggcggtggcgggtggtggtccttggaccacgcggtgggcggagccagcggcgacggcctcccctcccctccggacgcaggccggaagtacgtgagaggagacttccggccactgcgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagtgctcctgatatggaagatatattgactgaatcagaaattaaattggatggtgtcagacaaaagatattccaggtagcccaagagctatcaggggaagatatgcatcagttccatcgagccattactacaggactacaggaatatgtggaagctgtctcttttcaacacttcatcaaaacacgatcattaattagtatggatgaaattaataaacaattgatatttacgactgaagacaatgggaaagaaaataaaactccctcctctgatgcacaggataagcagtttggtacttggagactgagagtcacacctgtcgattaccttctgggagtggctgacttaactggagaattgatgcggatgtgtattaacagtgtggggaatggggacattgataccccctttgaagtgagccagtttttacgtcaggtttatgatgggttttcattcattggcaacactggaccttacgaggtttctaagaagctgtataccttgaaacaaagtttggccaaagtggagaatgcttgttatgccttgaaagtcagagggtcagaaattccaaaacatatgttggcagatgtgttttcagttaaaacagaaatgatagatcaagaagagggcatttcttagaatctaacgttactcagttactaattcttttgagaactcctaagagaccaatttgtaagacttatttagtatttcatttaactttattgtggcttttacatagaaacatattcagttgtacttgttttaaattgtatacaagctgtacataaaattagccaaatgaatcatttcttatatcttattcatgaaagtttgcatacagatgtttgcatatatgcctttttgaatttttgctggttaacctttatcatttatctttgtaatgtgaacatgcttcagagtgtaccttttgccataacctattttaatttactttttctgaagtttggagtgataatttttagtggaagcaatttgtaatttaagttggtagttatattatatatagaaaagattttttagttaaacttctggacatgagcgtcctgtttaaatttcttgttaatatcgtgccaagcctcaaaaataggcttattccatggaacaagaattaaaaatgaataagctatcaatatataatttaagtacaagtttaggctgggcgtggtggctcacgcctgtaatcccagcactttgggaggccgaggtaggcagatcacgaggtcaagagatcaagaccagcctgaccaacgtggcgaaacctcgtctctactagaaatacaaaaattagctggatatggtggtatgtgcctgtaatcccagctacttgggaggctgaggcaggagactcgcttgaacctgggaggcagaggttgcagtgagccgagattgcgccactgcactccagcctgggtaacagagcaagactccatctcaaaaaaagaaagaaagaaaaaagaaagtacaagtttataaagtattatagtgaaaaattcgcattctggctgattttaagccatttaaaatttatataaaacaaccttccataaaaatttgacaggtgcccagatgttgctttctccatttattttttgtttttttttaatcacagtaggtctgatagagaattggagctaaattataatatttttgttggtaaagttgagttatatacttgtacatacaatggaaatgcttttagtagtgattatttagcaatttttgtttttgttatattaggcatgtttggaggctttcctattctagcatttaaatttaaattttattaaaattaaataatttaaatctagcatttaaatttaaataatttaagtctagcatttacttttaaataattataatgaagttttgaaatactaagttaatccagacctttagttgtcccatggtgttaataaagttgccaaagaagatgtattatgaacaattcagcaataagacaattgtcaacacagttgagaataacaatggtaatcgttagtaatatttagaattggaatttgcctactgaaatagttatagatgattacttgtgatgtgaaactgaattgagcatgacaaccagacatttccagttggttttgtaagttttgagaatctagatactgggttttattttttgaaagattagctctgtttgtaagggctgattccttgaaaatgtaattttccagaaaaacacctaaagaaaataaaacatggacatgcctagtaaa

SEQ ID NO: 32239 - DNA, 644 bp, Homo sapiens
gagaggagacttccggccactgcgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagttcccaatatcttgatcatagtgctcctgatatggaagatatattgactgaatcagaaattaaattggatggtgtcagacaaaagatattccaggtagcccaagagctatcaggggaagatatgcatcagttccatcgagccattactacaggactacaggaatatgtggaagctgtctcttttcaacacttcatcaaaacacgatcattaattagtatggatgaaattaataaacaattgatatttacgactg

SEQ ID NO: 32240 - DNA, 680 bp, Homo sapiens
ggaagtaacccacgtgcttccgctggagcctctcgggaggcgggtaacgttatagtatttgtcagaagttggggtctccgtgggcattgtgatccgtcccaggcagtggattaggaggccagaaggagatcccttccacggtgctaggctgagatggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtcatctgtgaagactgccaggcctaggctctctgtagagagtcttcaagatcccggagtggtagcgctgtctcctggtgaaggagtatttgtcacactggaatgtgactgtgtgtgtatgtatgtgtatatatatatatatatatatatatatatatataaacaagtttgttgacacctac

SEQ ID NO: 32241 - DNA, 530 bp, Homo sapiens
ctcgggaggcgggtaacgttatagtatttgtcagaagttggggtctccgtgggcattgtgatccgtcccaggcagtgccccaggggtaggagagtgaacggcggcggtgggtgctgatggtgatgtctgctcccaggattaggaggccagaaggagatcccttccacggtgctaggctgagatggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtca

SEQ ID NO: 32242 - DNA, 486 bp, Homo sapiens
gcgagtttgaatcaaagaagaggcgggactttcctcccggaagtaacccacgtgcttccgctggagcctctcgggaggattaggaggccagaaggagatcccttccacggtgctaggctgagatggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtcatctgtgaagactgcc

SEQ ID NO: 32243 - DNA, 1948 bp, Homo sapiens
gcccttcgggacgagctggaggcagagcgtgagtacaaagtgatcggcctcggccgcacgtagtagcccccctactccccggccaagtcagggcctccctcttcccgcggagtcgcaaccacgggtagctcgtgtaggtaacggcaggtccaggcctccgcatgagcggagggccccccgcgcgaccttgaatggcccgggcgcgcgcggtcgtgtgggagttgtagtcctccgtccccgtccgcgcggactccgtttcccgtggtgccccgggcggcccgcttccggcgcagttagttacgagtcggcgcacgcggcctcggtccggttgactttgcggagccatggagggcggcttcggctccgatttcgggggctccggcagcgggaagctggacccagggctcataatggagcaggtgaaagtgcagatcgccgtggccaacgcgcaggagctgctgcagaggatgacggacaagtgtttccggaagtgtatagggaaacctgggggctccctggacaactccgagcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggcggggtccgcatgtacgtactgcctgcccggggcttaggagggtggcaccggtgctgggacacacgggactgtgtcctcgccaccccccgccctgccccctgccagccagtgcagcttggatctcgggggtgtggggccctgtgccttcctgaagtgctggcagcccagtggcacctccttcaggcctttggggtattcccctagtgtgcccaagtcagcctcatattctgggcggacagcttgtctggacttcggagttgggggtggtcagacaccacaggagctgtcacctcctgcggatgggcaaataaattggtggaggacggagagaaacctctttatttccctcctgaggggtctctgggaagaggtgacgcgtgtccctggaaccccagctcggagggtctcagcctcccctgggttgggagaagtccatctttccccttagtgccaccgggctgctgagtcacgaggaatgtgttgctgctgccacccctgccccaaaggctaagggggacagccttccccttgtcagggcttgctttgaccctgcttcgttccaccccgggtcctggtggagcaccaggcaggtggtcctcgctgtgacactgaggtgctgagccagtgagctagggtggaggggctgtgtttattggaacaaagggtggtaccaaaatgcatccccatgacccacagcccccccacacccgtccttgggtagggtacggtggggtggggtgttgggtggcctgctgctcctgttgctttcacgtagagtctcggcctgggcagtcacgtggtggtcactcctggatgtgctgtcctatccagcctctcacagctgccacccgggtatagacacctgggaagtggggccggccacagccatagccccagctagtgaccccagttagcacccaccgtccagagggctccctgcaggccaggggtcccccagcgtcaccctgttggggagagaagaaagggggttcagaggccggtacctcccctacagcagcccttgggtcattggcccctctaggagtgaccctagtgacttcccctgggagccgcattttcactatctggaaaatgggctcaatgcaaaggtggcagacatttatggacacccgccacgtggtcccggagtggaacggtgcctcccactgcagcctctgcctgctctgccgccgaggcccggggatgggatgcggtgggttgcccaataaacggctgtggagtggaaattcctccagagcc

SEQ ID NO: 32244 - DNA, 1659 bp, Homo sapiens
agcttgcccggcatcactcgcggcattggagtcaagatggaggagtacgcgcgagagccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggaggtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgcacagtttcccaatggtcctcagtttgcagaagacccctcccagttgccttcaactcagttaccttcctcaccttttggagactatcgacaatatcagtaggacttctttcctaggatttctttaacagaacgagttgtggttcgagaaggatttcagaagatcaagttacagtctgtttttaaaaccataggtgggacagctatggccaataggctataaagagacatttagcacttttttctatttaaaggaacaagcggggaagggtgctaaaagataatacgtttatttattcacacttgaattgcatttgtgatcaaaataaatgtttaaatcgctaaaggaaaatacagtaagtgcttgaaagatgaaggaccaaaaggccaaaaaacagtgaaatatgatcatcatctccttgcggacttctctgcctggttttgtgtgttctgttattcaaacaataaaaagctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatgtgttccaagtcctctgcataaacgatgtattttggggtctggttgggcctggaaaatggatgagcacttcagaacaggtcattttcctgatattggaagtgacatgtggccctataggaggcatgatgttagttaattacacatttgcctacatctgtgggaaatggagaacaaagccatgtgggtactgtaaacacacgtttatcttttggcccaatgccatacatatggtaggcatttaattactgattgtgtttggataatttgggaattttcgactgtggtaaaatatacataaaataatacttattaa

SEQ ID NO: 32245 - DNA, 950 bp, Homo sapiens
tgggggagcagagggcagcacttcctccagctccaaaagagtgcacccaccccaacgttaccaatacactcgtgcaggcggaaagctccgacgccggtgtgcgtctacgctgggggcgtggcctgactgcgcggccagacgccagcgccatggaggagtacgctcgggagccctgcccatggcgaattgtggatgattgcggtggagccttcactatgggtgtcatcggtggcggagtcttccaggccatcaagggtttccgcaatgcccctgttggaattcggcaccggttgagaggtagtgccaatgctgtgaggatccgagccccccagattggaggtagcttcgcagtgtgggggggcctgttctccaccattgactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaatgccta

SEQ ID NO: 32246 - DNA, 1099 bp, Homo sapiens
tgggggagcagagggcagcacttcctccagctccaaaagagtgcacccaccccaacgttaccaatacactcgtgcaggcggaaagctccgacgccggtgtgcgtctacgctgggggcgtggcctgactgcgcggccagacgccagcgccatggaggagtacgctcgggagccctgcccatggcgaattgtggatgattgcggtggagccttcactatgggtgtcatcggtggcggagtcttccaggccatcaagggtttccgcaatgcccctgtttgcagattgctgtctgaagctcccttgtttatctactcttgctcaagatctgtgtctcccaccgttaatgtgagctctgagagggcagagagcagacctaccttgttcatggctgtatccctgcatatggcatggtgcttggcacatataggaattcggcaccggttgagaggtagtgccaatgctgtgaggatccgagccccccagattggaggtagcttcgcagtgtgggggggcctgttctccaccattgactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaatgcct

SEQ ID NO: 32247 - DNA, 1671 bp, Homo sapiens
cgagggttgcttgggcagcgactgtcatggcggcggccgcccccaatgccggaggctcggcccctgagacagcgggttccgccgaagctccgctgcagtacagcctgctcctgcagtacctggtgggtgacaagcgtcagccccggctcctggagcctgggagcctgggcgggatcccaagtccagccaagagtgaggagcagaagatgatcgagaaggcgatggaaagctgcgctttcaaggctgcgctggcctgcgtgggaggatttgtcttaggaggtgcatttggggtgtttaccgctggcatcgataccaacgtgggctttgaccctaaggatccttaccgtacaccgactgcaaaagaagtgctgaaagacatggggcagagaggaatgtcctatgccaaaaatttcgccattgtgggagccatgttttcttgtactgagtgtttgatagaatcttaccggggaacatcagactggaagaacagtgtcatcagtggctgcatcacgggaggagctattggtttcagagctggcttaaaggctggggccattggttgtggaggttttgctgctttctctgctgcgattgattattacctccggtgagagtaattgcctgcagggaaggatgatgccagccccggatccgggctgctctctggaggacagtttctgtaccacaccagggccttgcttcagggcctgaagacattcattttccctcatgtcgttggtattctgagggagctgcctggcttctctgcctccagcctttggggtagccacactttgctgctcctggactccagccagccttcacagaggacgtcccgtgccagattctctcacagcagatcgggagacaggatgttgacatataggaattcagctccacaaagcttcaggcctgaccacagctggccctctaggttgtttggtgttgtgggcacagaggtgacagtgtctctgcaggcactcaggaagctgttctaccttggaactccatgcaactatccgtctcgaataccagggcagggcaaggcggactgatgccgtccaaccaattatctcacttgttttgtgttctgtcatccttgttttttttttaaaaatacactcccctcccccaccgccacacaccttacagttcaaaaggttggtttatttgtattttattttcaaattccctattccaaaaatagtgccgggtggcccaaagataacatctgaagggaaagaatgagaaagctcccagggaagcgggggatggggcgctgaggcagggttgttagaggactgtgtcatcctcaccaagctcattacatctgccagggcctgcctcaagaagcccagcccagccttttcctgggatgcagtgaaatcccatccatgaactcgatgggcccctcctgtgccggccgagaggcacacactgccttcacgacgtgactgctggacctggccgagcttgaggccacatgtgaagggtcctgctgtggtcatcttggtgactcggtcacagcagctactggccaagatcagacgtcgctgaggggctgttcaccaccatcctcgttctccagggtcaaggaagtgttttaacatgtcgtgttttcgacttgaccttgtggtatttttcttggcctagttgtgtgccatggatatt

SEQ ID NO: 32248 - DNA, 1178 bp, Homo sapiens
gaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactccaacacacaaa

SEQ ID NO: 32249 - DNA, 1022 bp, Homo sapiens
aggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacagctttgctctatagtgcatttggtgtcatcattgagaaaacacgaggtgcagaagatgaccttaacacagtagcagctggaaccatgacaggcatgttgtataaatgtacaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactcc

SEQ ID NO: 32250 - DNA, 848 bp, Homo sapiens
aggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggt

SEQ ID NO: 32251 - DNA, 752 bp, Homo sapiens
aggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacagcctcagcctcccaaagtgctaggattgcagatggtcttatttttacggagttttgctctgtcgccaggctgcagggcagtggcacaatcttggctcattacaacctccacctcccg

SEQ ID NO: 32252 - DNA, 746 bp, Homo sapiens
cgggggaagcggcaacaaaaccacagggggattggccggctttttcggagccggcggagcaggttactcgcacgcggatttggctggcgtcccgcctttgctctatagtgcatttggtgtcatcattgagaaaacacgaggtgcagaagatgaccttaacacagtagcagctggaaccatgacaggcatgttgtataaatgtacaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactccaacacacaaa

SEQ ID NO: 32253 - DNA, 1999 bp, Homo sapiens
aggcattccctacccttttaatgccccgccctatgacggacccaatcggagggctctccctacccgaaaccccgctcctggagcggcttttctcaggcttgcgcggctctaggccgaagcggcggatgacgcaaccgggccgcgccgcgagaaggtcacacgattctccaacatggcggcggcggccctgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaaaaacaaagaaatgaaagaaagtataaaaaaattccgtgacgaggccagaaggctagaagaatcagacgtgctccaggaggccagaaggaaatacaaaaccatcgagtcagaaaccgtgcggacgagcgaggtgctacggaagaagcttggggagctgacgggcaccgtgaaggagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccagggggtggagtccgtgaagaaggaaattgacgacagcgtcctgggacagaccgggccctaccggaggccccagcgactccggaagagaacggagtttgcgggagataagttcaaggaggagaaagtgtttgagccaaacgaggaggccctgggggtcgtgctgcacaaggactccaagtggtaccagcagtggaaggacttcaaggagaacaacgtggtgtttaaccggttcttcgagatgaagatgaagtatgacgaaagcgacaacgcgttcatccgggcatcccgggcccttacggacaaggtcaccgacttgctggggggcctgttctccaagacagagatgtcggaggtgctcacggagatcctccgggtggacccggcctttgacaaggaccggtttctgaaacagtgcgagaacgacatcatccccaatgtcctggaggccatgatttctggagagcttgacattctcaaagactggtgctatgaagctacttacagccagctggcccaccccatccagcaggccaaggcactgggtctccagttccattctcgcatcctagacattgacaacgtcgacctggccatgggcaagatgatggagcaggggccggtgctgatcatcaccttccaggcacagctggtgatggtggtcaggaaccccaaaggcgaggtggtggagggtgacccggacaaggtgctgcggatgctgtacgtgtgggcgctctgccgagaccaggacgagctcaacccctacgcggcctggcggctcctggacatctcggcctccagcaccgagcagattctctgagtgtggtgccggagccaggtagccccggcctgggtcatcaggcacagaggcaccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataaaacaccgaattgcagaagagc

SEQ ID NO: 32254 - DNA, 1664 bp, Homo sapiens
ttccctacgtcgggagaggaaaactccatcaaaaaacgaaagccaggggcccaggatagccaactaatcgacccagtcaactaactgacccagtgcacaactctggtagctcagaaaacgcgggctaatttggaagtggacaggggcggagctgtggggccagcacggaatggatcacgtggtctgaagtaacttccttttctcctttcttttctttttggagtaacatctcaacggcacctcggctctgggctgtaagccctgcgatctcaaggcgcaaggctgggcgcaacggcagggttgcggggttacgggattgcggggtccggggagtggaacccgccgactccgggaacgaagcaccggcgccaaggtgtgggaggcggcggggtggagttggacgcctgcctcgcgccgacgcagtgcactcacgggggcggtcccagaggcagctagctgtggttccggttccgtcgcggagacacgtgaaggtcggtgcggagttcgtctctgcaagcttggtcgccctgggatggattcctcctcctcttcctccgcggcgggtttgggtgcagtggacccgcagttgcagcatttcatcgaggtagagactcaaaagcagcgcttccagcagctggtgcaccagatgactgaactttgttgggagaagtgcatggacaagcctgggccaaagttggacagtcgggctgaggcctgttttgtgaactgcgttgagcgcttcattgatacaagccagttcatcttgaatcgactggaacagacccagaaatccaagccagttttctcagaaagcctttctgactgatctcagcattacctctttggaaaaggaaggtagttcaagaaatgaagagctgttgatgggatgattgaagaaacagctatgagaggattggctcccatcttttgttactcttgggacatcctgtcatctgagaatgaacaaagaccaattttttgtgtgtgaagcttaagggtcatatgtttgcttgtattttttaatgctaatcttgtgaaaataattgacaggcgaaagaaaactctatttagatgcatattactgtacatgggactatgcttttctcaaagccccattaactgcttcctataattttgatagtgggaccacatacgtaaaaatctctcatttgtgtggagtcatttctgatttcaggggagatccttgtgtttatcagaaagggcagaagtaggggaagaataatttggtatccttatctagtgtttgattgtcaatgctggagaaaaatatctgtaagagtgtttatacagtacacttcagttatcttgatctccctttcctatatgatgatttgcttaaatatccatattaagtaagtctcaaggtagggtaggcagcctgagagtctagaggcctttagttataaaggaatctagccagtgaacataattcttattactagactgccacaaggaagaaattaacttaccctgtatatcagggtacaaaaaattcagtgatgtgcctaaataagttataaagatttaggccaatcagaagctaacagcagtttcaggtagaggtgcatgcctaatgttagttagtgtagattccatttactgcattcttctgatcactgaaataaaagctatataagattcaa

SEQ ID NO: 32255 - DNA, 1336 bp, Homo sapiens
aagcgctctctggtgctcttccattcctctccgggtggaaacaaactccggacataacaggggtttatttatttatttattttaaggtagcacattgccgcacaagaccgctctacagtctcatccaagacttgaagagctcccgacttgtaatactacttgtgtttaccagggactgttgacactgcttcgcttccgaagaccgttagggacgtgggattagatttcctcgcgttataacgaatcggcgtctaagggtttaagtgtcacttgacattactgctcccacgtgttctttcccatctggcggccgcggctcctgtccagaccctgaccctccctcccaaggctcaaccgtcccccaacaacccccagccttgtactgatgtcggatgcgagagcctgtgcttaagtaagaatcaggccttattggagacattcaagcaaaggttggacaactacttttccagaacagaaaggaaactcatgcatcagaaaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgctatttaccaggaataatcacaatagaaggtcttattgttcagtgaaataataagatgcaacatttgttgaggccttatgattcagcagcttggtcacttgattagaaaaataaaccattgtttcttcaattgtgactgttaattttaaagcaacttatgtgttcgatcatgtatgagatagaaaaatttttattactcaaagtaaaataaatggaaatatcactgagcagttgtttatactgtatggtaccatagtattctcactggactgtggatacgttgaaatgtttttcaatcaggatcatcctccaagcagtcctgttcattcatgtctgcctcaaattgctggtgaatacataaaatagttacttgctaatcat

SEQ ID NO: 32256 - DNA, 598 bp, Homo sapiens
taatgatctgagaaattgggggtggtggcatacaattacatacacagatttataaaatacgagcagtgattccctaactcttcagttagactaaaaacatttgtttatagattgacaaacttgttttgaatttttaaattaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgc

SEQ ID NO: 32257 - DNA, 377 bp, Homo sapiens
tggcggccgcggctcctgtccagaccctgaccctccctcccaaggctcaaccgtcccccaacaacccccagccttgtactgatgtcggatgcgagagcctgtgcttaagtaagaatcaggccttattggagacattcaagcaaaggttggacaactacttttccagaacagaaaggaaactcatgcatcagaaaaggtttcagggatataatcagaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaag

SEQ ID NO: 32258 - DNA, 430 bp, Homo sapiens
actgctcccacgtgttctttcccatctggcggccgcggctcctgtccagaccctgaccctccctcccaaggctcaaccgtcccccaacaacccccagccttgtactgatgtcggatgcgagagcctgtgcttaagtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatag

SEQ ID NO: 32259 - DNA, 796 bp, Homo sapiens
gctctacagtctcatccaagacttgaagagctcccgacttgtaatactacttgtgtttaccagggactgttgacactgcttcgcttccgaagaccgttagggacgtgggattaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgctatttaccaggaataatcacaatagaaggtcttattgttcagtgaaataataagatgcaacatttgttgaggccttatgattcagcagcttggtcacttgattagaaaaataaaccattgtttcttcaattgtgactgttaattttaaagcaacttatgtgttcgatcatgtatgagatagaaaaatttttattactcaaagtaaaataaatggaaatatcactga

SEQ ID NO: 32260 - DNA, 1432 bp, Homo sapiens
ctcctttccgcttccggtgtcccctacagtcatggctgccgccgtcgctgctgccggtgcaggggaaccccagtccccggacgaattgctcccgaaaggcgacgcggagaagcctgaggaggagctggaggaggacgacgatgaggagctagatgagaccctgtcggagagactatggggcctgacggagatgtttccggagagggtccggtccgcggccggagccacttttgatctttccctctttgtggctcagaaaatgtacaggttttccagggcagccttgtggattgggaccacttcctttatgatcctggttcttcccgttgtctttgagacggagaagttgcaaatggagcaacagcagcaactgcagcagcggcagatacttctaggacctaacacagggctctcaggaggaatgccaggggctctaccctcacttcctggaaagatctagattgttattgctgtttgagctgtctcagtgggataagtttgaaattcaagtgtttgaactgctgataatttggatttttttttttttttaactttggcacattgatctatctaaacctggtggggagaattatccccacattgtctcatggaaagactcaacttgcaactgtgccctccacactatccttacttctgtctccactctgataccagagtgcagccatgcagatggttattccagctctggtcacccgactcctttcaccaaattgctcctaactggaagatctcactttccccttgtggggtaggaaccgatgccagtgggagggatgtgcccctgaccattaacgactgttttttttttttttttttaaagaatggagttgttggggcaggacatgcacacaatgtgaaacagacaaaatgcattacacctgtagtgtaaagtggccactatgaatccctatgtatgagaggagggaggcaggctgcagcttcagccacagaatggggactatggaagacagcaggagctcatttcctctgcacattttggctgttagacctgtgtgtgtgtttaaaaaaagagaagtcagtgctcactttttgtatttaaatattaaaaatgattccaactgaaagtgtcatcctaagtaccttgaaatgagaccacgtcagagacatgtactgcccctcacattttctcacctaaaccagcagcacctccatcttaacagccataggcccaaattgtttccaagtgaaaattcatttttagccaagtacttcatagcaatctttgccctgaatttaggcagtcactttgagatccatcagcctaaaacaaaggattgggtctatgtacttctttagtctataatgacactgtgtaattataaagtatttgtagggaataacatagtactgatttctggggaataggggagggggacagaatttttttttt

SEQ ID NO: 32261 - DNA, 1696 bp, Homo sapiens
ggggcgacggtggtggcggcggcggcagcgggttcggttgcgcgtggcgcacggggtgggagcggagcccaggccgggagcaggcgccgccgccagcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcgggggggacattggaaaggagggaccccgccaccccagcagctgaggaggggattctggaactgaatggcgcttcgggattctgagtagcaggggcagcatgcccagtgggcctggggtcccgggagggattccggaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaacaacaaaaaatatacgtggg

SEQ ID NO: 32262 - DNA, 1699 bp, Homo sapiens
ggggcgacggtggtggcggcggcggcagcgggttcggttgcgcgtggcgcacggggtgggagcggagcccaggccgggagcaggcgccgccgccacaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcgggggggacattggaaaggagggaccccgccaccccagcagctgaggaggggattctggaactgaatggcgcttcgggattctgagtagcaggggcagcatgcccagtgggcctggggtcccgggagggattccggaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaacaacaaaaaatatacgtggg

SEQ ID NO: 32263 - DNA, 1791 bp, Homo sapiens
ggggcgacggtggtggcggcggcggcagcgggttcggttgcgcgtggcgcacggggtgggagcggagcccaggccgggagcaggcgccgccgccagtgagaaccggggccggagccgggtgcggatttgctggggctgagtcgggggcgcgcgggccctgacctctgccctctgacctctcccctagcaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcgggggggacattggaaaggagggaccccgccaccccagcagctgaggaggggattctggaactgaatggcgcttcgggattctgagtagcaggggcagcatgcccagtgggcctggggtcccgggagggattccggaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaacaacaaaaaatatacgtggg

SEQ ID NO: 32264 - DNA, 2272 bp, Homo sapiens
atgccctctagtggctcagtgtccagaagccgccaacgaggacgatccatggcatcccggggctttgacgggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgttaagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtttctagactggaagaacaaatgaatggcttaaaaacatcaaatgaacatcttcaaaagcatgtggaggatctgttgaccaaattaaaagaggccaaggaacaacaggccagtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagtaaaagatctttcacaacagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaact

SEQ ID NO: 32265 - DNA, 7538 bp, Homo sapiens
gcgcaagaggatcagggatagcctctgagctcgggttcccagggttcgtagcttccaacggctgcgcgcgcacttcggtcgcgggcggtgaggtgctgttgctgaaacgctgccgctgagggtggactcgatttcccagggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgttaagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtttctagactggaagaacaaatgaatggcttaaaaacatcaaatgaacatcttcaaaagcatgtggaggatctgttgaccaaattaaaagaggccaaggaacaacaggccagtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagtaaaagatctttcacaacagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacgttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtaagagcagaaaatttgaagaaggaaaaggaaatgcttaaattgtctgaagttcgtctttctcagcaaagagagtctttgttagctgaacaaagggggcaaaacttactgctaactaatctgcaaacaattcagggaatactggagcgatctgaaacagaaaccaaacaaaggcttagtagccagatagaaaaactggaacatgagatctctcatctaaagaagaagttggaaaatgaggtggaacaaaggcatacacttactagaaatctagatgttcaacttttagatacaaagagacaactggatacagagacaaatcttcatcttaacacaaaagaactattaaaaaatgctcaaaaagaaattgccacattgaaacagcacctcagtaatatggaagtccaagttgcttctcagtcttcacagagaactggtaaaggtcagcctagcaacaaagaagatgtggatgatcttgtgagtcagctaagacagacagaagagcaggtgaatgacttaaaggagagactcaaaacaagtacgagcaatgtggaacaatatcaagcaatggttactagtttagaagaatccctgaacaaggaaaaacaggtgacagaagaagtgcgtaagaatattgaagttcgtttaaaagagtcagctgaatttcagacacagttggaaaagaagttgatggaagtagagaaggaaaaacaagaacttcaggatgataaaagaagagccatagagagcatggaacaacagttatctgaattgaagaaaacactttctagtgttcagaatgaagtacaagaagctcttcagagagcaagcacagctttaagtaatgagcagcaagccagacgtgactgtcaggaacaagctaaaatagctgtggaagctcagaataagtatgagagagaattgatgctgcatgctgctgatgttgaagctctacaagctgcgaaggagcaggtttcaaaaatggcatcagtccgtcagcatttggaagaaacaacacagaaagcagaatcacagttgttggagtgtaaagcatcttgggaggaaagagagagaatgttaaaggatgaagtttccaaatgtgtatgtcgctgtgaagatctggagaaacaaaacagattacttcatgatcagatcgaaaaattaagtgacaaggtcgttgcctctgtgaaggaaggtgtacaaggtccactgaatgtatctctcagtgaagaaggaaaatctcaagaacaaattttggaaattctcagatttatacgacgagaaaaagaaattgctgaaactaggtttgaggtggctcaggttgagagtctgcgttatcgacaaagggttgaacttttagaaagagagctgcaggaactgcaagatagtctaaatgctgaaagggagaaagtccaggtaactgcaaaaacaatggctcagcatgaagaactgatgaagaaaactgaaacaatgaatgtagttatggagaccaataaaatgctaagagaagagaaggagagactagaacaggatctacagcaaatgcaagcaaaggtgaggaaactggagttagatattttacccttacaagaagcaaatgctgagctgagtgagaaaagcggtatgttgcaggcagagaagaagctcttagaagaggatgtcaaacgttggaaagcacgtaaccagcatctagtaagtcaacagaaagatccagatacagaagaatatcggaagctcctttctgaaaaggaagttcatactaagcgtattcaacaattgacagaagaaattggtagacttaaagctgaaattgcaagatcaaatgcatctttgactaacaaccagaacttaattcagagtctgaaggaagatctaaataaagtaagaactgaaaaggaaaccatccagaaggacttagatgccaaaataattgatatccaagaaaaagtcaaaactattactcaagttaagaaaattggacgtaggtacaagactcaatatgaagaacttaaagcacaacaggataaggttatggagacatcggctcagtcctctggagaccatcaggagcagcatgtttcagtccaggaaatgcaggaactcaaagaaacgctcaaccaagctgaaacaaaatcaaaatcacttgaaagtcaagtagagaatctgcagaagacattatctgaaaaagagacagaagcaagaaatctccaggaacagactgtgcaacttcagtctgaactttcacgacttcgtcaggatcttcaagatagaaccacacaggaggagcagctccgacaacagataactgaaaaggaagaaaaaaccagaaaggctattgtagcagcaaagtcaaaaattgcacacttagctggtgtaaaagatcagctaactaaagaaaatgaggagcttaaacaaaggaatggagccttagatcagcagaaagatgaattggatgttcgcattactgcgctaaagtcccaatatgaaggtcgaattagtcgcttggaaagagaactcagggagcatcaagagagacaccttgagcagagagatgagcctcaagaaccttctaataaggtccctgaacagcagagacagatcacattgaaaacaactccagcttctggtgaaagaggaattgccagcacatcagacccaccaacagccaatatcaagccaactcctgttgtgtctactccaagtaaagtgacagctgcagctatggctggaaataagtcaacacccagggctagtatccgcccaatggttacacctgcaactgttacaaatcccactactaccccaacagctacagtgatgcccactacacaagtggaatcacaggaagctatgcagtcagaagggcctgtggaacatgttccagtttttggaagcacaagtggatccgttcgttctactagtcctaatgtccagccttctatctctcaacctattttaactgttcagcaacaaacacaggctacagcttttgtgcaacccactcaacagagtcatcctcagattgagcctgccaatcaagagttatcttcaaacatagtagaggttgttcagagttcaccagttgagcggccttctacttccacagcagtatttggcacagtttcggctacccccagttcttctttgccaaagcgtacacgtgaagaggaagaggatagcaccatagaagcatcagaccaagtctctgatgatacagtggaaatgcctcttccaaagaagttgaaaagtgtcacacctgtaggaactgaggaagaagttatggcagaagaaagtactgatggagaggtagagactcaggtatacaaccaggattctcaagattccattggagaaggagttacccagggagattatacacctatggaagacagtgaagaaacctctcagtctctacaaatagatcttgggccacttcaatcagatcagcagacgacaacttcatcccaggatggtcaaggcaaaggagatgatgtcattgtaattgacagtgatgatgaagaagaggatgatgatgaaaatgatggagaacatgaggattatgaagaggatgaggaagatgatgatgatgatgaagatgacacagggatgggagatgagggtgaagatagtaatgaaggaactggtagtgccgatggcaatgatggttatgaagctgatgatgctgagggtggtgatgggactgatccaggtacagaaacagaagaaagtatgggtggaggtgaaggtaatcacagagctgctgattctcaaaacagtggtgaaggaaatacaggtgctgcagaatcttctttttctcaggaggtttctagagaacaacagccatcatcagcatctgaaagacaggcccctcgagcacctcagtcaccgagacgcccaccacatccacttcccccaagactgaccattcatgccccacctcaggagttgggaccaccagttcagagaattcagatgacccgaaggcagtctgtaggacgtggccttcagttgactccaggaataggtggcatgcaacagcatttttttgatgatgaagacagaacagttccaagtactccaactcttgtggtgccacatcgtactgatggatttgctgaagcaattcattcgccgcaggttgctggtgtccctagattccggtttgggccacctgaagatatgccacaaacaagttctagtcactctgatcttggccagcttgcttctcaaggaggtttaggaatgtatgaaacacccctgttcctagctcatgaagaagagtcaggtggccgaagtgttcccactactccactacaagtagcagccccagtgactgtatttactgagagcaccacctctgatgcttcggaacatgcctctcaatctgttccaatggtgactacatccactggcactttatctacaacaaatgaaacagcaacaggtgatgatggagatgaagtatttgtggaggcagaatctgaaggtattagttcagaagcaggcctagaaattgatagccagcaggaagaagagccggttcaagcatctgatgagtcagatctcccctccaccagccaggatcctccttctagctcatctgtagatactagtagtagtcaaccaaagcctttcagacgagtaagacttcagacaacattgagacaaggtgtccgtggtcgtcagtttaacagacagagaggtgtgagccatgcaatgggagggagaggaggaataaacagaggaaatattaattaaatggtctgtaaacaataacaactgtgaataagattatcaaatctgttttagtgtaatgattgtcaagtttaaaaacatttttatatataaactggtatactcatgtcaatattctttattaataaaatgtttttcagtgtcaaaattta

SEQ ID NO: 32266 - DNA, 515 bp, Homo sapiens
ccttctgggcgccatagagagcgtggcggtatcccggagcctgccgtccggccctaccgggaccgatgccctctagtggctcagtgtccagaagccgccaacgaggacgatccatggcatcccggggctttgacgggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagag

SEQ ID NO: 32267 - DNA, 955 bp, Homo sapiens
ccctctcctgcccattccgcggatgggcaatcccaggcggaactcccttgagggtctcagaatatctgggagacctcgggctcttgatctccgagacaccccgtttcgtagtggagaacagtccagatcggggaagtttattttgcccaaagccggttagaggccccctggccctcgattcccagtgcggggctcagagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcacgaccacactcaactactgcgtatggcgggacaaccatggctggcgtgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggtggccccacctgagcccccacccgggagcagtgtcctgtgctttctgcatgcttagagcatgttcttggaacatggaattt

SEQ ID NO: 32268 - DNA, 881 bp, Homo sapiens
ggcggctgggaggggcggggcggatgcggggacagcggcctggctaactcctgccaggcagtgcccttcccggagcgtgccctcgccgctgagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcacgaccacactcaactactgcgtatggcgggacaaccatggctggcgtgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggtggccccacctgagcccccacccgggagcagtgtcctgtgctttctgcatgcttagagcatgttcttggaacatggaattttataagctgaataaagtttttgacttccttta

SEQ ID NO: 32269 - DNA, 636 bp, Homo sapiens
agcggcctggctaactcctgccaggcagtgcccttcccggagcgtgccctcgccgctggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcacgaccacactcaactactgcgtatggcgggacaaccatggctggcgtgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggtggccccacctgagcccccacccgggagcagtgtcctgtgctttctgcatgcttagagcatgttcttggaacatggaattttataagctgaataaagtttttgacttccttt

SEQ ID NO: 32270 - DNA, 672 bp, Homo sapiens
caggaagcgcggtcccaggagtggccgacgctccctctcctgcccattccgcggatgggcaatcccaggcggaactcccttgagggtctcagaatatctgggagacctcgggctcttgatctccgagacaccccgtttcgtagtggagaacagtccagatcggggaagtttattttgcccaaagccggttagaggccccctggccctcgattcccagtgcggggctcaggtgcgttgcagcctagacgggtcttactgtgagccgagcagcctctgggacctgtctgcttcccctaccccttgcaaagaagccggagcccagagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacagagaaggctgtggttcccctgggcctctacactgggcagctggccctgaactgggcatggccccccatcttctttggtgcccgacaaatgggctgg

SEQ ID NO: 32271 - DNA, 1771 bp, Homo sapiens
attaatcattttccctgttgcctatgactgaggctgtttctcacatcctgcccctggttttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcactgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtaatttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 32272 - DNA, 1646 bp, Homo sapiens
agagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcactgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaaatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtaatttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacc

SEQ ID NO: 32273 - DNA, 2101 bp, Homo sapiens
gtcaactcatcaggaccttttctctccctctctaccaatgctgaccttcctttccccttagccttagtggatgatggtttctttattcctatatggaagacatagctgagaaagttgattaggaaaactgtttttgctaattccatcacatcgtgtagggaaaagatagaacttaattacttaattgcgtaacaagtagagaaacacagcaatcagacaataaaatgaacagtagctttttgccttaaacaattcttttaagtctgagctcaatgatacacaactagaccatcaaattattttgatattgaggaaaacagaagctcttttggataaccctgaattccaggctttcagtggaaaagacaaagacacgcactgtacaccattaagtacttgggagacatgattttaaccaggatgtaactcaattatattagtgatttataaagagtctggagaaaatatttctttatttgggcatgggcactgtcagattaaaggtgcagtggttctaaatgctgtttgttccagccctgtcttcgattgcaacaatgtgagtgtcttgtctgtgctggtggattattaacagaggttattggtctccatggcaaaacgattgaatgattgctctgaacgtaatctcatttatgggggtgcaaaaaacaaagcacttcaggtcagggagaatgtataaatgtccattgccatcgaggttctgctatttttgagaagctgaagcaactccaaggacacagttcacagaaatttggttctcagccccaaaatactgattgaattggagacaattacaaggactctctggccaaaaacccttgaagaggccccgtgaaggaggcagtgaggagcttttgattgctgacctgtgtcgtaccaccccagaatgtgcactgggggctgtgccagatgcctgggggggaccctcattccccttgctttttttggcttcctggctaacatcctgttattttttcctggaggaaaagtgatagatgacaacgaccacctttcccaagagatctggtttttcggaggaatattaggaagcggtgtcttgatgatcttccctgcgctggtgttcttgggcctgaagaacaatgactgctgtgggtgctgcggcaacgagggctgtgggaagcgatttgcgatgttcacctccacgatatttgctgtggttggattcttgggagctggatactcgtttatcatctcagccatttcaatcaacaagggtcctaaatgcctcatggccaatagtacatggggctaccccttccacgacggggattatctcaatgatgaggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtgggggagatggacccgtttaaacctccgagatgagctgctcagactctacagcatgacgactacaatttcttttcataaaacttcttctcttcttggaattattaattcctatctgcttcctagctgataaagcttagaaaaggcagttattccttctttccaaccagctttgctcgagttagaattttgttattttcaaataaaaaatagtttggccacttaacaaatttgatttataaatctttcaaattagttcctttttagaatttaccaacaggttcaaagcatacttttcatgatttttttattacaaatgtaaaatgtataaagtcacatgtactgccatactacttctttgtatataaagatgtttatatctttggaagttttacataaatcaaaggaagaaagcacatttaaaatgagaaactaagaccaatttctgtttttaagaggaaaaagaatgattgatgtatcctaagtattgttatttgttgtctttttttgctgccttgcttgagttgcttgtgactgatcttttgaggctgtcatcatggctagggttcttttatgtatgttaaattaaaacctgaattcagaggtaacgt

SEQ ID NO: 32274 - DNA, 710 bp, Homo sapiens
actcaccgcctgtccttcctgacacctcaccatgtgtacgggaaaatgtgcccgctgtgtggggctctccctcattaccctctgcctcgtctgcattgtggccaacgccctcctgctggtacctaatggggagacctcctggaccaacaccaaccatctcagcttgcaagtctggctcatgggcggcttcattggcgggggcctaatggtactgtgtccggggattgcagccgttcgggcagggggcaagggctgctgtggtgctgggtgctgtggaaaccgctgcaggatgctgcgctcggtcttctcctcggcgttcggggtgcttggtgccatctactgcctctcggtgtctggagctgggctccgaaatggacccagatgcttaatgaacggcgagtggggctaccacttcgaagacaccgcgggagcttacttgctcaaccgcactctatgggatcggtgcgaggcgccccctcgcgtggtcccctggaatgtgacgctcttctcgctgctggtggccgcctcctgcctggagatagtactgtgtgggatccagctggtgaacgcgaccattggtgtcttctgcggcgattgcaggaaaaaacaggacacacctcactgaggctccactgaccgccgggttacacctgctccttcctggacgctcactcccttgctcgctagaataaactgctttgcgctctctt

SEQ ID NO: 32275 - DNA, 1419 bp, Homo sapiens
gggcgagcggcgcggcggctgcgatgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaatattgtttgacatataaaataattataagtgtaaaaaattacaatttagtgccaacagtagtgagcatgaaatgaaactattcaaaagagaatatggcctgtgcatattaaaaaattcaaaacagtgaatgcagactggaggagtaacttttgcaaataagatgaatatgcttcattattaaactcaatataaaaggcaaatcatcagaatatttttaaatgttgtttgaaaaatgttttcccaaggaaagtttattatttgctgctgtttcaagaaaattacttttactaaatttttttgtgtgaatttaaacagctaaatagggatcagtaactttatctctatccttaatgaacatttgttttattggtggctggaaatatttctattgtatttctgtgtatatttttaataaaattatttttggcctctt

SEQ ID NO: 32276 - DNA, 2074 bp, Homo sapiens
gtggcgcccctggcaggagcactgcaaggacgcctcccgggactgcaccgcggccctgcgcacttggggcgacggggccaggcgcgggggacggctgcgggctgggagggcgcgcggaggagacaccgctgaggggacgccgctgagggcgccacgcggggggcgcggctgaggcgcctcgaagggcaagcgccaagggggcgcgggcgccgccggaagctggggcggggcgcccagcgggatgcggtgaagggcgagcggcgcggcggctgcgatgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaggaaacttatagaaccattggcctatattgggttggatctattattatgagtgttgttgtttttgtgccaggaaacattgtagggaagtatggaacacgaatttgccctgcttttttcttaagcataccatatacttgtcttcctgtctgggctggtttcagaatctataatcagccatcagaaaattataattacccctcaaaggttattcaagaagcccaagcgaaagacctgctgagaagaccatttgatttaatgttggttgtgtgtctcctcctggcaactggattttgcctgttcagaggtttgattgctttggattgcccatctgagctctgccgattatatacgcaatttcaagagccctatctaaaggatcctgctgcttatcctaaaattcagatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaatattgtttgacatataaaataattataagtgtaaaaaattacaatttagtgccaacagtagtgagcatgaaatgaaactattcaaaagagaatatggcctgtgcatattaaaaaattcaaaacagtgaatgcagactggaggagtaacttttgcaaataagatgaatatgcttcattattaaactcaatataaaaggcaaatcatcagaatatttttaaatgttgtttgaaaaatgttttcccaaggaaagtttattatttgctgctgtttcaagaaaattacttttactaaatttttttgtgtgaatttaaacagctaaatagggatcagtaactttatctctatccttaatgaacatttgttttattggtggctggaaatatttctattgtatttctgtgtatatttttaataaaattatttttggcctctta

SEQ ID NO: 32277 - DNA, 1816 bp, Homo sapiens
cggctgaggcgcctcgaagggcaagcgccaagggggcgcgggcgccgccggaagctggggcggggcgcccagcgggatgcggtgaagggcgagcggcgcggcggctgcgatgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaggaaacttatagaaccattggcctatattgggttggatctattattatgagtgttgttgtttttgtgccaggaaacattgtagggaagtatggaacacgaatttgccctgcttttttcttaagcataccatatacttgtcttcctgtctgggctggtttcagaatctataatcagccatcagaaaattataattacccctcaaaggttattcaagaagcccaagcgaaagacctgctgagaagaccatttgatttaatgttggttgtgtgtctcctcctggcaactggattttgcctgttcagaggtttgatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaatattgtttgacatataaaataattataagtgtaaaaaattacaatttagtgccaacagtagtgagcatgaaatgaaactattcaaaagagaatatggcctgtgcatattaaaaaattcaaaacagtgaatgcagactggaggagtaacttttgcaaataagatgaatatgcttcattattaaactcaatataaaaggcaaatcatcagaatatttttaaatgttgtttgaaaaatgttttcccaaggaaagtttattatttgctgctgtttcaagaaaattacttttactaaatttttttgtgtgaatttaaacagctaaatagggatcagtaactttatctctatccttaatgaacatttgttttattggtggctggaaatatttctattgtatttctgtgtatatttttaataaaattatttttggcctctta

SEQ ID NO: 32278 - DNA, 1918 bp, Homo sapiens
cggctgaggcgcctcgaagggcaagcgccaagggggcgcgggcgccgccggaagctggggcggggcgcccagcgggatgcggtgaagggcgagcggcgcggcggctgcgatgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggattgttacagggaaacttatagaaccattggcctatattgggttggatctattattatgagtgttgttgtttttgtgccaggaaacattatagggaagtatggaacacgaatttgccctgcttttttcttaagcataccatatacttgtcttcctgtctgggctggtttcagaatctataatcagccatcagaaaattataattacccctcaaaggttattcaagaagcccaagcgaaagacctgctgagaagaccatttgatttaatgttggttgtgtgtctcctcctggcaactggattttgcctgttcagaggtttgattgctttggattgcccatctgagctctgccgattatatacgcaatttcaagagccctatctaaaggatcctgctgcttatcctaaaattcagatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaatattgtttgacatataaaataattataagtgtaaaaaattacaatttagtgccaacagtagtgagcatgaaatgaaactattcaaaagagaatatggcctgtgcatattaaaaaattcaaaacagtgaatgcagactggaggagtaacttttgcaaataagatgaatatgcttcattattaaactcaatataaaaggcaaatcatcagaatatttttaaatgttgtttgaaaaatgttttcccaaggaaagtttattatttgctgctgtttcaagaaaattacttttactaaatttttttgtgtgaatttaaacagctaaatagggatcagtaactttatctctatccttaatgaacatttgttttattggtggctggaaatatttctattgtatttctgtgtatatttttaataaaattatttttggcctctta

SEQ ID NO: 32279 - DNA, 1588 bp, Homo sapiens
cggctgaggcgcctcgaagggcaagcgccaagggggcgcgggcgccgccggaagctggggcggggcgcccagcgggatgcggtgaagggcgagcggcgcggcggctgcgatgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaggaaacttatagaaccattggcctatattgggttggatctattattatgagtgttgttgtttttgtgccaggaaacattgtagatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaatattgtttgacatataaaataattataagtgtaaaaaattacaatttagtgccaacagtagtgagcatgaaatgaaactattcaaaagagaatatggcctgtgcatattaaaaaattcaaaacagtgaatgcagactggaggagtaacttttgcaaataagatgaatatgcttcattattaaactcaatataaaaggcaaatcatcagaatatttttaaatgttgtttgaaaaatgttttcccaaggaaagtttattatttgctgctgtttcaagaaaattacttttactaaatttttttgtgtgaatttaaacagctaaatagggatcagtaactttatctctatccttaatgaacatttgttttattggtggctggaaatatttctattgtatttctgtgtatatttttaataaaattatttttggcctctt

SEQ ID NO: 32280 - DNA, 1020 bp, Homo sapiens
atgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaggaaacttatagaaccattggcctatattgggttggatctattattatgagtgttgttgtttttgtgccaggaaacattgtagggaagtatggaacacgaatttgccctgcttttttcttaagcataccatatacttgtcttcctgtctgggctggtttcagaatctataatcagccatcagaaaattataattacccctcaaaggttattcaagaagcccaagcgaaagacctgctgagaagaccatttgatttaatgttggttgtgtgtctcctcctggcaactggattttgcctgttcagaggtttgatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataa

SEQ ID NO: 32281 - DNA, 1106 bp, Homo sapiens
gcgccctggagaacgcgtcggggctgagccggggtccagcagccgccgctatggacatcccgccgctggccggcaagatcgcggcgctgtcgctgagcgccctcccggtgtcctacgcgctcaaccacgtctcggcgctctcgcaccccctgtgggtggcattgatgagcgccctaatcctgggtctgcttttcgtggcggtctacagcttgtcccatggcgaggtctcctatgacccactctatgctgtcttcgctgtcttcgccttcacctcggttgtggacctcatcatcgctcttcaggaagacagctatgtggtgggcttcatggagttctacaccaaggagggagagccatacctgcgcacagcgcacggagtcttcatctgctactgggatggcactgttcactacctcctctacctggccatggccggcgccatctgcagaaggaagagataccggaattttggactctactggctgggttccttcgccatgagcatcctggtgttccttacaggaaacattcttggcaaatacagctccgagatcaggcctgccttcttcctcaccatcccctacctgctggtgccatgctgggctggcatgaaggtcttcagccagccccgggcgctaacccgctgcaccgccaacatggtgcaagaggaacaaagaaagggactcctgcagcgtccggctgacctggcccttgtcatatatctcatccttgctggcttcttcactctgttccggggcctggtggtgcttgattgccccacagatgcctgctttgtctatatctaccagtatgagccatacctgcgggaccctgtggcctaccctaaggtgcagatgctgatgtacatgttttatgtcctgcctttctgcggcctggctgcctatgctctcaccttccctggttgctcctggcttccagactgggccttggtgtttgctggaggcatcggccaggcacagttctcgcacatgggggcttccatgcacctgcgcacacccttcacctaccgttgccttcagtggcccgcattcttccaccagccaccaccctccgaccccctagccctccacaagaagcagcattga

SEQ ID NO: 32282 - DNA, 1483 bp, Homo sapiens
gcgccctggagaacgcgtcggggctgagccggggtccagcagccgccgctatggacatcccgccgctggccggcaagatcgcggcgctgtcgctgagcgccctcccggtgtcctacgcgctcaaccacgtctcggcgctctcgcaccccctgtgggtggcattgatgagcgccctaatcctgggtctgcttttcgtggcggtctacagcttgtcccatggcgaggtctcctatgacccactctatgctgtcttcgctgtcttcgccttcacctcggttgtggacctcatcatcgctcttcaggaagacagctatgtggtgggcttcatggagttctacaccaaggagggagagccatacctgcgcacagcgcacggagtcttcatctgctactgggatggcactgttcactacctcctctacctggccatggccggcgccatctgcagaaggaagagataccggaattttggactctactggctgggttccttcgccatgagcatcctggtgttccttacaggaaacattcttggcaaatacagctccgagatcaggcctgccttcttcctcaccatcccctacctgctggtgccatgctgggctggcatgaaggtcttcagccagccccgggcgctaacccgctgcaccgccaacatggtgcaagaggaacaaagaaagggactcctgcagcgtccggctgacctggcccttgtcatatatctcatccttgctggcttcttcactctgttccggggcctggtggtgcttgattgccccacagatgcctgctttgtctatatctaccagtatgagccatacctgcgggaccctgtggcctaccctaaggtgcagatgctgatgtacatgttttatgtcctgcctttctgcggcctggctgcctatgctctcaccttccctggttgctcctggcttccagactgggccttggtgtttgctggaggcatcggccaggcacagttctcgcacatgggggcttccatgcacctgcgcacacccttcacctaccgtgtgcctgaggacacctggggctgcttcttcgtgtgcaatctgctgtatgcgctgggcccccacctgctggcctaccgttgccttcagtggcccgcattcttccaccagccaccaccctccgaccccctagccctccacaagaagcagcattgagagagctgtggactcaggacccaggactctgtttacgtgcccagtcagccctacctggggaagcgggggttgggtgttttagagacaggagggacatctccgggtgtctttagtcttggctatggtagtttcagtccagtgggtgggatggagaccaacgaccaagtgttcctgcaaggagagcctcccacagctgtcaccatgctccaactcccacacaaacgcttctaccccttccagaacttacccatcatccccccatggatcctttcagtaaaaaccctttcaatttccaaaat

SEQ ID NO: 32283 - DNA, 1829 bp, Homo sapiens
gcgccctggagaacgcgtcggggctgagccggggtccagcagccgccgctatggacatcccgccgctggccggcaagatcgcggcgctgtcgctgagcgccctcccggtgtcctacgcgctcaaccacgtctcggcgctctcgcaccccctgtgggtggcattgatgagcgccctaatcctgggtctgcttttcgtggcggtctacagcttgtcccatggcgaggtctcctatgacccactctatgctgtcttcgctgtcttcgccttcacctcggttgtggacctcatcatcgctcttcaggaagacagctatgtggtgggcttcatggagttctacaccaaggaggtacttgggggacgaccagggagccccctaccgcactgcccgtctgagtctcccacctgcccccacagggagagccatacctgcgcacagcgcacggagtcttcatctgctactgggatggcactgttcactacctcctctacctggccatggccggcgccatctgcagaaggtgcaggaggcagggagagggtggcccctgaccctgggagagaagttgcatcctcagatggggtcccagggcagggtggagccagaagtgtctgtaggagaaatcaggacgcctctctagggctccagccaggggtggccaggagaaggttccagggaacgtctcaggtgtaggtggtggcctagcattgcttacatccaccctgtgcctgggcagccacttctgttcttggacagagggtctcactgttatttccccgttcaactccctgttgtcccttccatcctgggcaaaactgaaagggacccggagctgggaaacccacggtggtctccaggccctggctggggctctgagattacggagtgactacctgctggtcacccctccatcccctgctcaggaagagataccggaattttggactctactggctgggttccttcgccatgagcatcctggtgttccttacaggaaacattcttggtgcaagaggaacaaagaaagggactcctgcagcgtccggctgacctggcccttgtcatatatctcatccttgctggcttcttcactctgttccggggcctggtggtgcttgattgccccacagatgcctgctttgtctatatctaccagtatgagccatacctgcgggaccctgtggcctaccctaaggtgcagatgctgatgtacatgttttatgtcctgcctttctgcggcctggctgcctatgctctcaccttccctggttgctcctggcttccagactgggccttggtgtttgctggaggcatcggccaggcacagttctcgcacatgggggcttccatgcacctgcgcacacccttcacctaccgtgtgcctgaggacacctggggctgcttcttcgtgtgcaatctgctgtatgcgctgggcccccacctgctggcctaccgttgccttcagtggcccgcattcttccaccagccaccaccctccgaccccctagccctccacaagaagcagcattgagagagctgtggactcaggacccaggactctgtttacgtgcccagtcagccctacctggggaagcgggggttgggtgttttagagacaggagggacatctccgggtgtctttagtcttggctatggtagtttcagtccagtgggtgggatggagaccaacgaccaagtgttcctgcaaggagagcctcccacagctgtcaccatgctccaactcccacacaaacgcttctaccccttccagaacttacccatcatccccccatggatcctttcagtaaaaaccctttcaatttccaaaat

SEQ ID NO: 32284 - DNA, 1722 bp, Homo sapiens
gggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcggagatgctcttcctcctttggataaacactgggaacccttggtgcacttctctcccctaggactggctgggtcagcactgatcagggagaagctgagcagtggcttgtgggcccaggaatctg

SEQ ID NO: 32285 - DNA, 1490 bp, Homo sapiens
tgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcgga

SEQ ID NO: 32286 - DNA, 1671 bp, Homo sapiens
gttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaaggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcggagatgctcttcctcctttggataaacactgggaacccttggtgcacttctctcccctaggactggctgggtcagcactgatcagggagaagctgagcagtggcttgtgggcccaggaatctggggtctggtgggacaatagctatccctc

SEQ ID NO: 32287 - DNA, 2709 bp, Homo sapiens
gttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgag

SEQ ID NO: 32288 - DNA, 579 bp, Homo sapiens
gcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgaggtttatctcgttgtaggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtact

SEQ ID NO: 32289 - DNA, 1953 bp, Homo sapiens
gcatttctgcattcgaagaagaatctgagagaaacctgacgcagggagcatgggtatctggacctcaggcactgatatcttcctaagtctttgggagatttacgtgtctccaagaagccccggatggatggactttatccagcatttgggagtttgctgtttggttgctcttatttcagtgggcctcctgtctgtggccgcctgctggtttctgccatcaatcatagcggccgctgcctcctggattatcacgtgtgttctgctgtgttgctccaagcatgcacgatgttttattcttcttgtctttctctcttgtggcctgcgtgaaggcaggaatgctttgattgcagctggcacagggatcgtcatcttgggacacgtagaaaatatttttcacaactttaaaggtctcctagatggtatgacttgcaacctaagggcaaagagcttttccatacattttccacttttgaaaaaatatattgaggcaattcagtggatttatggccttgccactccactaagtgtatttgatgaccttgtttcttggaaccagaccctggcagtctctcttttcagtcccagccatgtcctggaggcacagctaaatgacagcaaaggggaagtcctgagcgtcttgtaccagatggcaacaaccacagaggtgttgtcctccctgggtcagaagctacttgcctttgcagggctttcgctcgtcctgcttggcactggcctcttcatgaagcgatttttgggcccttgtggttggaagtatgaaaacatctacatcaccagacaatttgttcagtttgatgaaagggagagacatcaacagaggccctgtgtgctcccgctgaataaggaggaaaggaggaagtatgtcatcatcccgactttctggccgactcctaaagaaaggaaaaacctggggctgtttttcctccccatacttatccatctctgcatctgggtgctgtttgcagctgtagattatctgctgtatcggctcattttctcagtgagcaagcagtttcaaagcttgccagggtttgaggttcacttgaaactgcacggagagaaacaaggaactcaagatattatccatgattcttcctttaatatatctgtgtttgaacccaactgtatcccaaaaccaaaattccttctatctgagacctgggttcctctcagtgttattcttttgatattagtgatgctgggactgttgtcctctatccttatgcaacttaaaatcctggtgtcagcatctttctaccccagcgtggagaggaagcgcatccaatatctgcatgcaaagctgcttaaaaaaagatcaaagcagccgctgggagaagtcaaaagacggctgagtctctatcttacaaagattcatttctggcttccagtcctgaaaatgattaggaagaagcaaatggacatggcaagtgcagacaagtcatgagagaccccgactactcctcagccacatcgcaccaacaattctcttcaggtctaggatggcagtcactattcatgccggataatagagaactatgtgacgcagtcctctcaggagtctgagtttacagagccaacttgcagcacctggttatgcctcctttcatctcaaagccaaagagctgccaggtaaatggttatgtggtctatgttccaaacaaaccacatgatcttgcctgtgtcacaatgtaacaagactctagctgggtcccctggtgatgagtttcagcatagaataatgttcaaggaaaagaaaacgaaaacagtttaaatctctaccacagcctcacaagcaaatgctaaggggaacatacatgtaaaaagccagcaaactatcttcaaactcttccgtccttaatgtcttccatggctattgcccccacaatggtctcttttctccctgctcccttattaaagaactctttctgaaaccca

SEQ ID NO: 32290 - DNA, 2224 bp, Homo sapiens
ctaatattacgaccacagaagttgggctgaggtagaagtcaagactatcccaataactggattctggccgagaaaaaggcgcgcgccagcaccccagtcagtaaaatctaccgggcaaagttcgccgccgccactatcctcctctggctctgaaatagttccaattctcgcgagattcggcctgactaccagcccttcagctccagtgagttgcgggttggtttcctctagactctcgtggccacaccgttctccgatacgagcctttccggtgctatgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaaggagagatctgtttcattttgttttgccgtatttctagatataagttttagcatgggccaggaaggactaaaataaaagtttttaaggtactgtactttttgccatacttgactcatatactcaaaatacagagttgtcttggtgtaggaattggaaagcaagagtggaaaggaacgtaataactcgttggagtttaaaaatgagggtcttggcaagtaacactgatgtctgaaaaaaaattaaatataaataaataaataaaaatgagggtcctcagctgttctcttcatatcctattacagtctctcagattcttgtgggggcactcttagatctcccttggagacaaggttatagttatatgttgttaatctcgcagagcttccttttagtcacaatagccttcattttctgccatgccccttcataagggagaaggatgtttgtaccatgatcctccccgcataatctatggaattaggagtcctgtgtggagtcttatcaataaatatgcacattcatcaaatgtctacttaaatgtgagtattctaccagtgagaaaaaacacataattttcaaggtaatcattgttaaaccaacagcaaacttctttcttatcagcaccataaagtccagaagacagtagaaaagtatcttcaaagtgctgaggaaaataagtatcaacttagaattttatgtacaatattggaggcaaaataaagacatgtttagacatacaaaa

SEQ ID NO: 32291 - DNA, 1129 bp, Homo sapiens
aagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaagttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgt

SEQ ID NO: 32292 - DNA, 1016 bp, Homo sapiens
tttgaagggtgtcattttggtaatctgctattttatgatgcactatgttgactactccatgatgtaccacctgataagggggcagtccgtcatcaagctctacatcatctacaacatgctggaggtagctgatcgtctgttttcatcttttggacaagacatattagatgctctctattggacagcaacagagcctaaagaaagaaaaagagcccacattgggtttgttgaaattaaaggaagtgttttcaagaagtttgaaaagaacaatctctttcaaatgtcaaatagcgatattaaggaacgattcacaaattatgtgcttttactgatagtgtgtctaagaaacatggaacagttttcttggaatccagatcatctctgggtgttgtttccagatgtctgtatggtaattgcatcagaaattgccgtggatattgtaaaacatgcctttattactaaattcaatgacattactgcagatgtctacagtgaatatagagccagtcttgcttttgaccttgttagcagccgacagaaaaatgcatacactgattacagtgactctgtagcacggaggatgggctttattcctctcccactagctgttttagttgatatccctgaaagtacttaatagcatcgtgctgttggggaaatcgtgccagtatgtgaaggaagccaaaatggaagagaagctgtcgaatcctcccgcaacctgcactccaggcaagccgtccagtaaatcacagaacaaatgtaaaccctctcaaggcctttccacagaagaaaacctgtctgcctccatcaccaaacaacctattcatcaaaaggaaaatatcataccattacttgtgacaagcaattctgatcagtttttgacaactccagatggtgacgagaaggacataacgcaggacaattctgaattaaaacacagatcctcaaagaaagatttgttagagatagacaggttcacaatttgtggaaaccgaattgactgaatctgtggcttc

SEQ ID NO: 32293 - DNA, 1634 bp, Homo sapiens
gttgtgctcggaacatggcgggcgtcggcgacgcggccgctccgggagaaggcggcggtggcggcgtggacggcccgcagcgggacggccgcggcgaggcggagcagccgggcggcagcggcggacaggggcccccgccggcgcctcagctcacagagacgctgggcttctacgagagcgaccggcggcgggagaggcgccggggccgcacagctgatggtttttggaatctttctgtgcctggatgcgtttttgtatgtgttcaccctgcttcctttaagagttttcctggcactattcaggctcctcactttgccttgctatggcttaagggacagacgtttgcttcagcctgcccaggtgtgtgacattttgaagggtgtcattttggtaatctgctattttatgatgcactatgttgactactccatgatgtaccacctgataagggggcagtccgtcatcaagctctacatcatctacaacatgctggaggtagctgatcgtctgttttcatcttttggacaagacatattagatgctctctattggacagcaacagagcctaaagaaagaaaaagagcccacattggggtgattcctcactttttcatggctgttctctatgtctttttgcatgcaattcttataatggttcaagcaacaactctcaatgtagcttttaactcacacaacaagtctttgcttactatcatgatgtctaataattttgttgaaattaaaggaagtgttttcaagaagtttgaaaagaacaatctctttcaaatgtcaaatagcgatattaaggaacgattcacaaattatgtgcttttactgatagtgtgtctaagaaacatggaacagttttcttggaatccagatcatctctgggtgttgtttccagatgtctgtatggtaattgcatcagaaattgccgtggatattgtaaaacatgcctttattactaaattcaatgacattactgcagatgtctacagtgaatatagagccagtcttgcttttgaccttgttagcagccgacagaaaaatgcatacactgattacagtgactctgtagcacggaggatgggctttattcctctcccactagctgttttactcatcagagttgtaacaagctcaattaaagtgcaaggaatcctgtcttatgcctgtgtcatactcttctattttgggttgatatccctgaaagtacttaatagcatcgtgctgttggggaaatcgtgccagtatgtgaaggaagccaaaatggaagagaagctgtcgaatcctcccgcaacctgcactccaggcaagccgtccagtaaatcacagaacaaatgtaaaccctctcaaggcctttccacagaagaaaacctgtctgcctccatcaccaaacaacctattcatcaaaaggaaaatatcataccattacttgtgacaagcaattctgatcagtttttgacaactccagatggtgacgagaaggacataacgcaggacaattctgaattaaaacacagatcctcaaagaaagatttgttagagatagacaggttcacaatttgtggaaaccgaattgactgaatctgtggcttcatgcgctgaagaagctgggtcctggggcaacaagt

SEQ ID NO: 32294 - DNA, 4591 bp, Homo sapiens
gaggggcggggcgaggcggggagggggccggccggaggcagaggctggagggaggcggcggggacagtttgttgtgctcggaacatggcgggcgtcggcgacgcggccgctccgggagaaggcggcggtggcggcgtggacggcccgcagcgggacggccgcggcgaggcggagcagccgggcggcagcggcggacaggggcccccgccggcgcctcagctcacagagacgctgggcttctacgagagcgaccggcggcgggagaggcgccggggccgcacagagctttcattgttgaggttcctcagtgctgaactaacaagagggtacttccttgaacataatgaggccaagtatacagaaagaagagaaagagtatacacttgtttgcgaataccaagagaattggaaaagctgatggtttttggaatctttctgtgcctggatgcgtttttgtatgtgttcaccctgcttcctttaagagttttcctggcactattcaggctcctcactttgccttgctatggcttaagggacagacgtttgcttcagcctgcccaggtgtgtgacattttgaagggtgtcattttggtaatctgctattttatgatgcactatgttgactactccatgatgtaccacctgataagggggcagtccgtcatcaagctctacatcatctacaacatgctggaggtagctgatcgtctgttttcatcttttggacaagacatattagatgctctctattggacagcaacagagcctaaagaaagaaaaagagcccacattggggtgattcctcactttttcatggctgttctctatgtctttttgcatgcaattcttataatggttcaagcaacaactctcaatgtagcttttaactcacacaacaagtctttgcttactatcatgatgtctaataattttgttgaaattaaaggaagtgttttcaagaagtttgaaaagaacaatctctttcaaatgtcaaatagcgatattaaggaacgattcacaaattatgtgcttttactgatagtgtgtctaagaaacatggaacagttttcttggaatccagatcatctctgggtgttgtttccagatgtctgtatggtaattgcatcagaaattgccgtggatattgtaaaacatgcctttattactaaattcaatgacattactgcagatgtctacagtgaatatagagccagtcttgcttttgaccttgttagcagccgacagaaaaatgcatacactgattacagtgactctgtagcacggaggatgggctttattcctctcccactagctgttttactcatcagagttgtaacaagctcaattaaagtgcaaggaatcctgtcttatgcctgtgtcatactcttctattttgggttgatatccctgaaagtacttaatagcatcgtgctgttggggaaatcgtgccagtatgtgaaggaagccaaaatggaagagaagctgtcgaatcctcccgcaacctgcactccaggcaagccgtccagtaaatcacagaacaaatgtaaaccctctcaaggcctttccacagaagaaaacctgtctgcctccatcaccaaacaacctattcatcaaaaggaaaatatcataccattacttgtgacaagcaattctgatcagtttttgacaactccagatggtgacgagaaggacataacgcaggacaattctgaattaaaacacagatcctcaaagaaagatttgttagagatagacaggttcacaatttgtggaaaccgaattgactgaatctgtggcttcatgcgctgaagaagctgggtcctggggcaacaagtgctgtgttgccaggacaaatagatgctaaacatggcacttaaatatttatttaaaaacttaaattattattggcaagcaaatcttagtatctttcttccagtaatatggcctggctgagggtcagaccacaggacaggagcgacctccggccttgactgtctgggaagcttgatggattataaaacttcctcctgcctggccaagcagcagcatcatttccaggacccaacaaaggcaacatcaaaatctgttttgctttgtcagtctgggcttccagaatgttgaatttgcctcaaggcctcttcagtataaggaaatacctggaaaactgtgaaacttttaccacgacgtaatctttccagtctcatactattttcacaaacagttttcaaacgttacttcatctgccaaagcattaaaaaaattaaacataagtcaagataaatgttcttaccaccagaataacccttaaagatgtatcttaattaatcagaataaaaggctaccttaaataagacatgatgaatagtagcattttgtagggttaaaaaaaaatgctaaactagtttatttattaaaaaaataattaatgaaggctatgcattactgggaaaaatccttcataatttttcagtttactctttaaagcaaaatgtgagctgtatgtcatttaattggtggataaaacaaatttccttacaaaagggcactttttacaccaaggaagcagagcagtgttaactttaaggtatacttaactgattttgctttaaaactaattacttcataaattattacagctaaaaggattcgatgttgaacaggctgaaaaattgtcaatgtacaaaattcaaaactgtcaactttaactgtaaagtaaatgctccaagtgtgttagacagcatcatcttgcttgggcttaccaaatgcattagtctttgtgtttgggtcgacagcgagtgtgcctgtgctggggcagggtgtgtgttctgtgggagggtgtctgtggggatgtgactatcagggtgggcctgtgctggggatggggcaggcctgggtctggagaggattttgtgtgaaagtaaatggggtgtttgaggcgtatgggtggctgttggtgtggggaggcatctgtgtatggctgttgggaacagcaaccaaaaggtgctttttggttttatttgagatgaagattgtgtttccgcttaattactagtttgtggtctatatcatagaagttatttcccaccccattttatcttgacaaccgtgtttgcatttctgtaaaacttctacaacttctggtgtcagaactgtccagaagatggtactgttaactgttatttcctttgatgttttgattttgaagtttagctctcatgcaaatgtttcaggcgtacatacataggcagaaagcaatttttaggtgatttgtctgtttcttggatgaaatataaagcaagctttaatgttctgacttgttcatttgaaatacaaaaaagtaagtgaattttaatgttttgcattaactaaagaaatctgaagattaatgttgaggaaattgtatggacatgcctttgtgaaaccaggaagtattttaagttaaaaatgaaaaaggttttaattgctttgtgtgtgttttaatggagccccattttagaattattttttccatctccctttaccaacaaaaggaacaatgccaccgtgaatggaatagtttggggaaagctttgccaaacacaaccctgatttcagagcaggaacatggtttggatagatcttcagttccgcttgaattattctgttactgcgctgtcattttcagaagatttccattcctttgcagatgctgttgggagttcgggattatgttcatttcttctgttttaatggcattcagtactaattttataagtgcatcttgtgtgaatctcaataaattcagttttgtaatcttttttaaaaaggtcactgaatttattttaatatttactattgtatttggtagagtgaatttcccactgtataataagtatttatttgtaattcacaagtgatagagctatcttaatttgaattattgctttggtcttaatggtggcaaaatgtttaattttgtctttggaaaaaataggctcggccttgattatagaccatttaatatttctcagcaaatgaaggtatttgcattttacaagtgttttgaatgtcacacaaaatatttttcacatctgggagtcaagttcaagacagtgctttggttttaaaaaaatctaatgaaggcacaggataggccagacccttattaggttttcctttagaataagtgtaaagaccaagtgtcactgatacgcttgtccagattttcttgtggactttggccagtatttagagtttatattcatgttacataaagtgaaagaaacttgctataattaggccatcaaaatatatcctgccactcctggtaactcagcagaggaggagataaatttacaaaataatgtaatatctctacattgttacatgttttcaactattttttatcaacaaagatttgttaatcacttcctatgtgtcagaaactgttctaagtggtgggatcagcaatgagcaagataagtccctgttcgtctgtggaagactgataggaacaagtcgatgaaataatgtctgctggtcacagagtgtccactgaccaaatgatctctcaggcttatttcagctctaaaatatagttctttaaaacgtt

SEQ ID NO: 32295 - DNA, 1770 bp, Homo sapiens
gggcggggcgaggcggggagggggccggccggaggcagaggctggagggaggcggcggggacagtttgttgtgctcggaacatggcgggcgtcggcgacgcggccgctccgggagaaggcggcggtggcggcgtggacggcccgcagcgggacggccgcggcgaggcggagcagccgggcggcagcggcggacaggggcccccgccggcgcctcagctcacagagacgctgggcttctacgagagcgaccggcggcgggagaggcgccggggccgcacagagctttcattgttgaggttcctcagtgctgaactaacaagagggtacttccttgaacataatgaggccaagtatacagaaagaagagaaagagtatacacttgtttgcgaataccaagagaattggaaaagctgatggtttttggaatctttctgtgcctggatgcgtttttgtatgtgttcaccctgcttcctttaagagttttcctggcactattcaggctcctcactttgccttgctatggcttaagggacagacgtttgcttcagcctgcccaggtgtgtgacattttgaagggtgtcattttggtaatctgctattttatgatgcactatgttgactactccatgatgtaccacctgataagggggcagtccgtcatcaagctctacatcatctacaacatgctggaggtagctgatcgtctgttttcatcttttggacaagacatattagatgctctctattggacagcaacagagcctaaagaaagaaaaagagcccacattggggtgattcctcactttttcatggctgttctctatgtctttttgcatgcaattcttataatggttcaagcaacaactctcaatgtagcttttaactcacacaacaagtctttgcttactatcatgatgtctaataattttgttgaaattaaaggaagtgttttcaagaagtttgaaaagaacaatctctttcaaatgtcaaatagcgatattaaggaacgattcacaaattatgtgcttttactgatagtgtgtctaagaaacatggaacagttttcttggaatccagatcatctctgggtgttgtttccagatgtctgtatggtaattgcatcagaaattgccgtggatattgtaaaacatgcctttattactaaattcaatgacattactgcagatgtctacagtgaatatagagccagtcttgcttttgaccttgttagcagccgacagaaaaatgcatacactgattacagtgactctgtagcacggaggatgggctttattcctctcccactagctgttttactcatcagagttgtaacaagctcaattaaagtgcaaggaatcctgtcttatgcctgtgtcatactcttctattttgggttgatatccctgaaagtacttaatagcatcgtgctgttggggaaatcgtgccagtatgtgaaggaagccaaaatggaagagaagctgtcgaatcctcccgcaacctgcactccaggcaagccgtccagtaaatcacagaacaaatgtaaaccctctcaaggcctttccacagaagaaaacctgtctgcctccatcaccaaacaacctattcatcaaaaggaaaatatcataccattacttgtgacaagcaattctgatcagtttttgacaactccagatggtgacgagaaggacataacgcaggacaattctgaattaaaacacagatcctcaaaatctgttttgctttgtcagtctgggcttccagaatgttga

SEQ ID NO: 32296 - DNA, 3201 bp, Homo sapiens
cagaaactatgagggcagaacccagcaatctgtgctttctttcacaagccctccaggagttgctgaaatttaggaatcattgccccaaaaagtggccctcataatgatgccagatgggatcttactctgttgcccaggctggagtgcagtggtgcgatctcggctctctgcaacctccgcctcccaggttcaagtgattctcctgcctcggcctcctgagtagctgggatttcaggccatgaaagatcactgttttagtctgcgtggtgcagtggaacagatagacctcggtttgaatctcagctctactgtttactagacatgaaatggggaaatctaaaatgagatgccagaagcctcaaaaatggaaaaccccctgtgcttcacatctgaaaatctctgctgggggcagcaactttgagcctgtggggaaggaactgtccacgtggagtggtctggtgaatgcttaaggagctgcagaagggaagtccctctccaaactagccagccactgagaccttctgacaggacacccccaggatgtcacccaaaaaagtacaaatcaaagtggaggaaaaagaagacgagactgaggaaagctcaagtgaagaggaagaggaggtggaagataagctacctcgaagagagagcttgagaccaaagaggaaacggaccagagatgttatcaatgaggatgacccagaacctgaaccagaggatgaagaaacaaggaaggcaagagaaaaagagaggaggaggaggctaaagagaggagcagaagaagaagaaattgatgaagaggaattggaaagattgaaggcagagttagatgagaaaagacaaataattgctactgtcaaatgcaaaccatggaagatggagaagaaaattgaagttctcaaggaggcaaaaaaatttgtgagtgaaaatgaaggggctcttgggaaaggaaaaggaaaacggtggtttgcatttaagatgatgatggccaagaaatgggcaaaattcctccgtgattttgagaacttcaaagctgcgtgtgtcccatgggaaaataaaatcaaggctattgaaagtcagtttggctcctcagtggcctcatacttcctcttcttgagatggatgtatggagtcaatatggttctctttatcctgacatttagcctcatcatgttgccagagtacctctggggtttgccatatggcagtttacctaggaaaaccgttcccagagccgaagaggcatcggcagcaaactttggtgtgttgtacgacttcaatggtttggcacaatattccgttctcttttatggctattatgacaataaacgaacaattggatggatgaatttcaggttgccgctctcctattttctagtggggattatgtgcattggatacagctttctggttgtcctcaaagcaatgaccaaaaacattggtgatgatggaggtggagatgacaacactttcaatttcagctggaaggtctttaccagctgggactacctgatcggcaatcctgaaacagcagacaacaaatttaattctatcacaatgaactttaaggaagctatcacagaagaaaaagcagcccaagtagaagaaaacgtccacttgatcagattcctgaggtttctggctaacttcttcgtgtttctaacacttggagggagtggatacctcatcttttgggctgtgaagcgatcccaggaatttgcacagcaagatcctgacacccttgggtggtgggaaaaaaatgaaatgaacatggttatgtccctcctagggatgttctgtccaacattgtttgacttatttgctgaattagaagactaccatcctctcatcgctttgaaatggctactgggacgcatttttgctcttcttttaggcaatttatacgtatttattcttgcattaatggatgagattaacaacaagattgaagaggagaagctagtaaaggccaatattaccctttgggaagccaatatgatcaaggcctacaatgcatcattctctgaaaatagcactggaccacccttttttgttcaccctgcagatgtacctcgaggaccttgctgggaaacaatggtgggacaggagtttgtgaggctgacagtctctgatgttctgaccacctacgtcacaatcctcattggggactttctaagggcatgttttgtgaggttttgcaattattgctggtgctgggacttggagtatggatatccttcatacaccgaattcgacatcagtggcaacgtcctcgctctgatcttcaaccaaggcatgatctggatgggctccttctttgctcccagcctcccaggcatcaatatccttcgactccatacatccatgtacttccagtgctgggccgttatgtgctgcaatgttcctgaggccagggtcttcaaagcttccagatcaaataacttctacctgggcatgctactgctcatcctcttcctgtccacaatgcctgtcttgtacatgatcgtgtccctcccaccatcttttgattgtggtccattcagtggcaaaaatagaatgtttgaagtcattggagagaccctggagcacgatttcccaagctggatggcgaagatcttgagacagctttcaaaccctgggctggtcattgctgtcattttggtgatggttttggccatctattatctcaatgctactgccaagggccagaaggcagcgaatctggatctcaaaaagaagatgaaaatgcaagctttggagaacaaaatgcgaaacaagaaaatggcagctgcacgagcagctgcagctgctggtcgccagtaataagtatcctgagagcccagaaaaggtacactttgccttgctgtttaaaagtaatgcaatatgtgaacgcccagagaacaagcactgtggaactgctattttcctgttctacccttgatggattttcaaggtcatgctggccaattaaggcatcatcagtcctacctgagcaacaagaatctaaactttattccaagtcagaaactgtttctgcagagccactctctcccctgctccatttcgtgactttttttttttttttaacaaattgagtttagaagtgagtgtaatccagcaatacagtttactggtttagttggtgggttaattaaaaaaaatttgctcatatgaactttcattttatatgtttcttttgcc

SEQ ID NO: 32297 - DNA, 3090 bp, Homo sapiens
agacagagtcttgctctgttgcccaggccagaatgcagtggcgtgatctcggttcactgtaaccaccgcctcccaggttcaagtgattcttgtgtctcagcctcctgagtagctgggattacaggccatgaaagatcactgttttagtctgcgtggtgcagtggaacagatagacctcggtttgaatctcagctctactgtttactagacatgaaatggggaaatctaaaatgagatgccagaagcctcaaaaatggaaaaccccctgtgcttcacatctgaaaatctctgctgggggcagcaactttgagcctgtggggaaggaactgtccacgtggagtggtctggtgaatgcttaaggagctgcagaagggaagtccctctccaaactagccagccactgagaccttctgacaggacacccccaggatgtcacccaaaaaagtacaaatcaaagtggaggaaaaagaagacgagactgaggaaagctcaagtgaagaggaagaggaggtggaagataagctacctcgaagagagagcttgagaccaaagaggaaacggaccagagatgttatcaatgaggatgacccagaacctgaaccagaggatgaagaaacaaggaaggcaagagaaaaagagaggaggaggaggctaaagagaggagcagaagaagaagaaattgatgaagaggaattggaaagattgaaggcagagttagatgagaaaagacaaataattgctactgtcaaatgcaaaccatggaagatggagaagaaaattgaagttctcaaggaggcaaaaaaatttgtgagtgaaaatgaaggggctcttgggaaaggaaaaggaaaacggtggtttgcatttaagatgatgatggccaagaaatgggcaaaattcctccgtgattttgagaacttcaaagctgcgtgtgtcccatgggaaaataaaatcaaggctattgaaagtcagtttggctcctcagtggcctcatacttcctcttcttgagatggatgtatggagtcaatatggttctctttatcctgacatttagcctcatcatgttgccagagtacctctggggtttgccatatggcagtttacctaggaaaaccgttcccagagccgaagaggcatcggcagcaaactttggtgtgttgtacgacttcaatggtttggcacaatattccgttctcttttatggctattatgacaataaacgaacaattggatggatgaatttcaggttgccgctctcctattttctagtggggattatgtgcattggatacagctttctggttgtcctcaaagcaatgaccaaaaacattggtgatgatggaggtggagatgacaacactttcaatttcagctggaaggtctttaccagctgggactacctgatcggcaatcctgaaacagcagacaacaaatttaattctatcacaatgaactttaaggaagctatcacagaagaaaaagcagcccaagtagaagaaaacgtccacttgatcagattcctgaggtttctggctaacttcttcgtgtttctaacacttggagggagtggatacctcatcttttgggctgtgaagcgatcccaggaatttgcacagcaagatcctgacacccttgggtggtgggaaaaaaatgaaatgaacatggttatgtccctcctagggatgttctgtccaacattgtttgacttatttgctgaattagaagactaccatcctctcatcgctttgaaatggctactgggacgcatttttgctcttcttttaggcaatttatacgtatttattcttgcattaatggatgagattaacaacaagattgaagaggagaagctagtaaaggccaatattaccctttgggaagccaatatgatcaaggcctacaatgcatcattctctgaaaatagcactggaccacccttttttgttcaccctgcagatgtacctcgaggaccttgctgggaaacaatggtgggacaggagtttgtgaggctgacagtctctgatgttctgaccacctacgtcacaatcctcattggggactttctaagggcatgttttgtgaggttttgcaattattgctggtgctgggacttggagtatggatatccttcatacaccgaattcgacatcagtggcaacgtcctcgctctgatcttcaaccaaggcatgatctggatgggctccttctttgctcccagcctcccaggcatcaatatccttcgactccatacatccatgtacttccagtgctgggccgttatgtgctgcaatgttcctgaggccagggtcttcaaagcttccagatcaaataacttctacctgggcatgctactgctcatcctcttcctgtccacaatgcctgtcttgtacatgatcgtgtccctcccaccatcttttgattgtggtccattcagtggcaaaaatagaatgtttgaagtcattggagagaccctggagcacgatttcccaagctggatggcgaagatcttgagacagctttcaaaccctgggctggtcattgctgtcattttggtgatggttttggccatctattatctcaatgctactgccaagggccagaaggcagcgaatctggatctcaaaaagaagatgaaaatgcaagctttggagaacaaaatgcgaaacaagaaaatggcagctgcacgagcagctgcagctgctggtcgccagtaataagtatcctgagagcccagaaaaggtacactttgccttgctgtttaaaagtaatgcaatatgtgaacgcccagagaacaagcactgtggaactgctattttcctgttctacccttgatggattttcaaggtcatgctggccaattaaggcatcatcagtcctacctgagcaacaagaatctaaactttattccaagtcagaaactgtttctgcagagccactctctcccctgctccatttcgtgactttttttttttttttaacaaattgagtttagaagtgagtgtaatccagcaatacagtttactggtttagttggtgggttaattaaaaaaaatttgctcatatgaactttcattttatatgtttcttttgcc

SEQ ID NO: 32298 - DNA, 2221 bp, Homo sapiens
cgtggagtggtctggtgaatgcttaaggagctgcagaagggaagtacaaatcaaagtggaggaaaaagaagacgagactgaggaaagctcaagtgaagaggaagaggaggtggaagataagctacctcgaagagagagcttgagaccaaagaggaaacggaccagagatgttatcaatgaggatgacccagaacctgaaccagaggatgaagaaacaaggaaggcaagagaaaaagagaggaggaggaggctaaagagaggagcggaggcaaaaaaatttgtgagtgaaaatgaaggggctcttgggaaaggaaaaggaaaacggtggtttgcatttaagatgatgatggccaagaaatgggcaaaattcctccgtgattttgagaacttcaaagctgcgtgtgtcccatgggaaaataaaatcaaggctattgaaagtcagtttggctcctcagtggcctcatacttcctcttcttgagatggatgtatggagtcaatatggttctctttatcctgacatttagcctcatcatgttgccagagtacctctggggtttgccatatggcagtttacctaggaaaaccgttcccagagccgaagaggcatcggcagcaaactttggtgtgttgtacgacttcaatggtttggcacaatattccgttctcttttatggctattatgacaataaacgaacaattggatggatgaatttcaggttgccgctctcctattttctagtggggattatgtgcattggatacagctttctggttgtcctcaaagcaatgaccaaaaacattggtgatgatggaggtggagatgacaacactttcaatttcagctggaaggtctttaccagctgggactacctgatcggcaatcctgaaacagcagacaacaaatttaattctatcacaatgaactttaaggaagctatcacagaagaaaaagcagcccaagtagaagaaaacgtccacttgatcagattcctgaggtttctggctaacttcttcgtgtttctaacacttggagggagtggatacctcatcttttgggctgtgaagcgatcccaggaatttgcacagcaagatcctgacacccttgggtggtgggaaaaaaatgaaatgaacatggttatgtccctcctagggatgttctgtccaacattgtttgacttatttgctgaattagaagactaccatcctctcatcgctttgaaatggctactgggacgcatttttgctcttcttttaggcaatttatacgtatttattcttgcattaatggatgagattaacaacaagattgaagaggagaagctagtaaaggccaatattaccctttgggaagccaatatgatcaaggcctacaatgcatcattctctgaaaatagcactggaccacccttttttgttcaccctgcagatgtacctcgaggaccttgctgggaaacaatggtgggacaggagtttgtgaggctgacagtctctgatgttctgaccacctacgtcacaatcctcattggggactttctaagggcatgttttgtgaggttttgcaattattgctggtgctgggacttggagtatggatatccttcatacaccgaattcgacatcagtggcaacgtcctcgctctgatcttcaaccaaggcatgatctggatgggctccttctttgctcccagcctcccaggcatcaatatccttcgactccatacatccatgtacttccagtgctgggccgttatgtgctgcaatgttcctgaggccagggtcttcaaagcttccagatcaaataacttctacctgggcatgctactgctcatcctcttcctgtccacaatgcctgtcttgtacatgatcgtgtccctcccaccatcttttgattgtggtccattcagtggcaaaaatagaatgtttgaagtcattggagagaccctggagcacgatttcccaagctggatggcgaagatcttgagacagctttcaaaccctgggctggtcattgctgtcattttggtgatggttttggccatctattatctcaatgctactgccaagggccagaaggcagcgaatctggatctcaaaaagaagatgaaaatgctgcagctgctggtcgccagtaataagtatcctgagagcccagaaaaggtacactttgccttgctgtttaaaagtaatgcaatatgtgaacgcccagagaacaagcactgt

SEQ ID NO: 32299 - DNA, 2371 bp, Homo sapiens
atgtcacccaaaaaagtacaaatcaaagtggaggaaaaagaagacgagactgaggaaagctcaagtgaagaggaagaggaggtggaagataagctacctcgaagagagagcttgagaccaaagaggaaacggaccagagatgttatcaatgaggatgacccagaacctgaaccagaggatgaagaaacaaggaaggcaagagaaaaagagaggaggaggaggctaaagagaggagcagaagaagaagaaattgatgaagaggaattggaaagattgaaggcagagttagatgagaaaagacaaataattgctactgtcaaatgcaaaccatggaagatggagaagaaaattgaagttctcaaggaggcaaaaaaatttgtgagtgaaaatgaaggggctcttgggaaaggaaaaggaaaacggtggtttgcatttaagatgatgatggccaagaaatgggcaaaattcctccgtgattttgagaacttcaaagctgcgtgtgtcccatgggaaaataaaatcaaggctattgaaagtcagtttggctcctcagtggcctcatacttcctcttcttgagatggatgtatggagtcaatatggttctctttatcctgacatttagcctcatcatgttgccagagtacctctggggtttgccatatggcagtttacctaggaaaaccgttcccagagccgaagaggcatcggcagcaaactttggtgtgttgtacgacttcaatggtttggcacaatattccgttctcttttatggctattatgacaataaacgaacaattggatggatgaatttcaggttgccgctctcctattttctagtggggattatgtgcattggatacagctttctggttgtcctcaaagcaatgaccaaaaacattggtgatgatggaggtggagatgacaacactttcaatttcagctggaaggtctttaccagctgggactacctgatcggcaatcctgaaacagcagacaacaaatttaattctatcacaatgaactttaaggaagctatcacagaagaaaaagcagcccaagtagaagaaaacgtccacttgatcagattcctgaggtttctggctaacttcttcgtgtttctaacacttggagggagtggatacctcatcttttgggctgtgaagcgatcccaggaatttgcacagcaagatcctgacacccttgggtggtgggaaaaaaatgaaatgaacatggttatgtccctcctagggatgttctgtccaacattgtttgacttatttgctgaattagaagactaccatcctctcatcgctttgaaatggctactgggacgcatttttgctcttcttttaggcaatttatacgtatttattcttgcattaatggatgagattaacaacaagattgaagaggagaagctagtaaaggccaatattaccctttgggaagccaatatgatcaaggcctacaatgcatcattctctgaaaatagcactggaccacccttttttgttcaccctgcagatgtacctcgaggaccttgctgggaaacaatggtgggacaggagtttgtgaggctgacagtctctgatgttctgaccacctacgtcacaatcctcattggggactttctaagggcatgttttgtgaggttttgcaattattgctggtgctgggacttggagtatggatatccttcatacaccgaattcgacatcagtggcaacgtcctcgctctgatcttcaaccaaggcatgatctggatgggctccttctttgctcccagcctcccaggcatcaatatccttcgactccatacatccatgtacttccagtgctgggccgttatgtgctgcaatgttcctgaggccagggtcttcaaagcttccagatcaaataacttctacctgggcatgctactgctcatcctcttcctgtccacaatgcctgtcttgtacatgatcgtgtccctcccaccatcttttgattgtggtccattcagtggcaaaaatagaatgtttgaagtcattggagagaccctggagcacgatttcccaagctggatggcgaagatcttgagacagctttcaaaccctgggctggtcattgctgtcattttggtgatggttttggccatctattatctcaatgctactgccaagggccagaaggcagcgaatctggatctcaaaaagaagatgaaaatgcaagctttggagaacaaaatgcgaaacaagaaaatggcagctgcacgagcagctgcagctgctggtcgccagtaataagtatcctgagagcccagaaaaggtacactttgccttgctgtttaaaagtaatgcaatatgtgaacgcccagagaacaagcactgt

SEQ ID NO: 32300 - DNA, 2273 bp, Homo sapiens
cgtggagtggtctggtgaatgcttaaggagctgcagaagggaagtacaaatcaaagtggaggaaaaagaagacgagactgaggaaagctcaagtgaagaggaagaggaggtggaagataagctacctcgaagagagagcttgagaccaaagaggaaacggaccagagatgttatcaatgaggatgacccagaacctgaaccagaggatgaagaaacaaggaaggcaagagaaaaagagaggaggaggaggctaaagagaggagcggaggcaaaaaaatttgtgagtgaaaatgaaggggctcttgggaaaggaaaaggaaaacggtggtttgcatttaagatgatgatggccaagaaatgggcaaaattcctccgtgattttgagaacttcaaagctgcgtgtgtcccatgggaaaataaaatcaaggctattgaaagtcagtttggctcctcagtggcctcatacttcctcttcttgagatggatgtatggagtcaatatggttctctttatcctgacatttagcctcatcatgttgccagagtacctctggggtttgccatatggcagtttacctaggaaaaccgttcccagagccgaagaggcatcggcagcaaactttggtgtgttgtacgacttcaatggtttggcacaatattccgttctcttttatggctattatgacaataaacgaacaattggatggatgaatttcaggttgccgctctcctattttctagtggggattatgtgcattggatacagctttctggttgtcctcaaagcaatgaccaaaaacattggtgatgatggaggtggagatgacaacactttcaatttcagctggaaggtctttaccagctgggactacctgatcggcaatcctgaaacagcagacaacaaatttaattctatcacaatgaactttaaggaagctatcacagaagaaaaagcagcccaagtagaagaaaacgtccacttgatcagattcctgaggtttctggctaacttcttcgtgtttctaacacttggagggagtggatacctcatcttttgggctgtgaagcgatcccaggaatttgcacagcaagatcctgacacccttgggtggtgggaaaaaaatgaaatgaacatggttatgtccctcctagggatgttctgtccaacattgtttgacttatttgctgaattagaagactaccatcctctcatcgctttgaaatggctactgggacgcatttttgctcttcttttaggcaatttatacgtatttattcttgcattaatggatgagattaacaacaagattgaagaggagaagctagtaaaggccaatattaccctttgggaagccaatatgatcaaggcctacaatgcatcattctctgaaaatagcactggaccacccttttttgttcaccctgcagatgtacctcgaggaccttgctgggaaacaatggtgggacaggagtttgtgaggctgacagtctctgatgttctgaccacctacgtcacaatcctcattggggactttctaagggcatgttttgtgaggttttgcaattattgctggtgctgggacttggagtatggatatccttcatacaccgaattcgacatcagtggcaacgtcctcgctctgatcttcaaccaaggcatgatctggatgggctccttctttgctcccagcctcccaggcatcaatatccttcgactccatacatccatgtacttccagtgctgggccgttatgtgctgcaatgttcctgaggccagggtcttcaaagcttccagatcaaataacttctacctgggcatgctactgctcatcctcttcctgtccacaatgcctgtcttgtacatgatcgtgtccctcccaccatcttttgattgtggtccattcagtggcaaaaatagaatgtttgaagtcattggagagaccctggagcacgatttcccaagctggatggcgaagatcttgagacagctttcaaaccctgggctggtcattgctgtcattttggtgatggttttggccatctattatctcaatgctactgccaagggccagaaggcagcgaatctggatctcaaaaagaagatgaaaatgcaagctttggagaacaaaatgcgaaacaagaaaatggcagctgcacgagcagctgcagctgctggtcgccagtaataagtatcctgagagcccagaaaaggtacactttgccttgctgtttaaaagtaatgcaatatgtgaacgcccagagaacaagcactgt

SEQ ID NO: 32301 - DNA, 2477 bp, Homo sapiens
cgtggagtggtctggtgaatgcttaaggagctgcagaagggaagtacaaatcaaagtggaggaaaaagaagacgagactgaggaaagctcaagtgaagaggaagaggaggtggaagataagctacctcgaagagagagcttgagaccaaagaggaaacggaccagagatgttatcaatgaggatgacccagaacctgaaccagaggatgaagaaacaaggaaggcaagagaaaaagagaggaggaggaggctaaagagaggagcggaggcaaaaaaatttgtgagtgaaaatgaaggggctcttgggaaaggaaaaggaaaacggtggtttgcatttaagatgatgatggccaagaaatgggcaaaattcctccgtgattttgagaacttcaaagctgcgtgtgtcccatgggaaaataaaatcaaggctattgaaagtcagtttggctcctcagtggcctcatacttcctcttcttgagatggatgtatggagtcaatatggttctctttatcctgacatttagcctcatcatgttgccagagtacctctggggtttgccatatggcagtttacctaggaaaaccgttcccagagccgaagaggcatcggcagcaaactttggtgtgttgtacgacttcaatggtttggcacaatattccgttctcttttatggctattatgacaataaacgaacaattggatggatgaatttcaggttgccgctctcctattttctagtggggattatgtgcattggatacagctttctggttgtcctcaaagcaatgaccaaaaacattggtgatgatggaggtggagatgacaacactttcaatttcagctggaaggtctttaccagctgggactacctgatcggcaatcctgaaacagcagacaacaaatttaattctatcacaatgaactttaaggaagctatcacagaagaaaaagcagcccaagtagaagaaaacgtccacttgatcagattcctgaggtttctggctaacttcttcgtgtttctaacacttggagggagtggatacctcatcttttgggctgtgaagcgatcccaggaatttgcacagcaagatcctgacacccttgggtggtgggaaaaaaatgaaatgaacatggttatgtccctcctagggatgttctgtccaacattgtttgacttatttgctgaattagaagactaccatcctctcatcgctttgaaatggctactgggacgcatttttgctcttcttttaggcaatttatacgtatttattcttgcattaatggatgagattaacaacaagattgaagaggagaagctagtaaaggccaatattaccctttgggaagccaatatgatcaaggcctacaatgcatcattctctgaaaatagcactggaccacccttttttgttcaccctgcagatgtacctcgaggaccttgctgggaaacaatggtgggacaggagtttgtgaggctgacagtctctgatgttctgaccacctacgtcacaatcctcattggggactttctaagggcatgttttgtgaggttttgcaattattgctggtgctgggacttggagtatggatatccttcatacaccgaattcgacatcagtggcaacgtcctcgctctgatcttcaaccaaggcatgatctgatctgtcctgaattattaaacctttgggtgctgacagacaccggacccctctgcaaatgctaaaaccgtcttgcttctgtcacacaaagacaactctccagggctccatcgtcctgccatgggatgactgttaaattcctgtgcctgactaggtgaatcaatatggaaaagatattataaaaatattgtttcctcctttgtcaggatgggctccttctttgctcccagcctcccaggcatcaatatccttcgactccatacatccatgtacttccagtgctgggccgttatgtgctgcaatgttcctgaggccagggtcttcaaagcttccagatcaaataacttctacctgggcatgctactgctcatcctcttcctgtccacaatgcctgtcttgtacatgatcgtgtccctcccaccatcttttgattgtggtccattcagtggcaaaaatagaatgtttgaagtcattggagagaccctggagcacgatttcccaagctggatggcgaagatcttgagacagctttcaaaccctgggctggtcattgctgtcattttggtgatggttttggccatctattatctcaatgctactgccaagggccagaaggcagcgaatctggatctcaaaaagaagatgaaaatgcaagctttggagaacaaaatgcgaaacaagaaaatggcagctgcacgagcagctgcagctgctggtcgccagtaataagtatcctgagagcccagaaaaggtacactttgccttgctgtttaaaagtaatgcaatatgtgaacgcccagagaacaagcactgt

SEQ ID NO: 32302 - DNA, 2308 bp, Homo sapiens
cgtggagtggtctggtgaatgcttaaggagctgcagaagggaagtacaaatcaaagtggaggaaaaagaagacgagactgaggaaagctcaagtgaagaggaagaggaggtggaagataagctacctcgaagagagagcttgagaccaaagaggaaacggaccagagatgttatcaatgaggatgacccagaacctgaaccagaggatgaagaaacaaggaaggcaagagaaaaagagaggaggaggaggctaaagagaggagcagaagaagaagaaattgatgaagaggaattggaaagattgaaggcagagttagatgagaaaagacaaataattgctactgtcaaatgcaaaccatggaagatggagaagaaaattgaagttctcaaggaggcaaaaaaatttgtgagtgaaaatgaaggggctcttgggaaaggaaaaggaaaacggtggtttgcatttaagatgatgatggccaagaaatgggcaaaattcctccgtgattttgagaacttcaaagctgcgtgtgtcccatgggaaaataaaatcaaggctattgaaagtcagtttggctcctcagtggcctcatacttcctcttcttgagatggatgtatggagtcaatatggttctctttatcctgacatttagcctcatcatgttgccagagtacctctggggtttgccatatggcagtttacctaggaaaaccgttcccagagccgaagaggcatcggcagcaaactttggtgtgttgtacgacttcaatggtttggcacaatattccgttctcttttatggctattatgacaataaacgaacaattggatggatgaatttcaggttgccgctctcctattttctagtggggattatgtgcattggatacagctttctggttgtcctcaaagcaatgaccaaaaacattggtgatgatggaggtggagatgacaacactttcaatttcagctggaaggtctttaccagctgggactacctgatcggcaatcctgaaacagcagacaacaaatttaattctatcacaatgaactttaaggaagctatcacagaagaaaaagcagcccaagtagaagaaaacgtccacttgatcagattcctgaggtttctggctaacttcttcgtgtttctaacacttggagggagtggatacctcatcttttgggctgtgaagcgatcccaggaatttgcacagcaagatcctgacacccttgggtggtgggaaaaaaatgaaatgaacatggttatgtccctcctagggatgttctgtccaacattgtttgacttatttgctgaattagaagactaccatcctctcatcgctttgaaatggctactgggacgcatttttgctcttcttttaggcaatttatacgtatttattcttgcattaatggatgagattaacaacaagattgaagaggagaagctagtaaaggccaatattaccctttgggaagccaatatgatcaaggcctacaatgcatcattctctgaaaatagcactggaccacccttttttgttcaccctgcagatgtacctcgaggaccttgctgggaaacaatggtgggacaggagtttgtgaggctgacagtctctgatgttctgaccacctacgtcacaatcctcattggggactttctaagggcatgttttgtgaggttttgcaattattgctggtgctgggacttggagtatggatatccttcatacaccgaattcgacatcagtggcaacgtcctcgctctgatcttcaaccaaggcatgatctggatgggctccttctttgctcccagcctcccaggcatcaatatccttcgactccatacatccatgtacttccagtgctgggccgttatgtgctgcaatgttcctgaggccagggtcttcaaagcttccagatcaaataacttctacctgggcatgctactgctcatcctcttcctgtccacaatgcctgtcttgtacatgatcgtgtccctcccaccatcttttgattgtggtccattcagtggcaaaaatagaatgtttgaagtcattggagagaccctggagcacgatttcccaagctggatggcgaagatcttgagacagctttcaaaccctgggctggtcattgctgtcattttggtgatggttttggccatctattatctcaatgctactgccaagggccagaaggcagcgaatctggatctcaaaaagaagatgaaaatgcaagctttggagaacaaaatgcgaaacaagaaaatggcagctgcacgagcagatggggcggctggccgggcg

SEQ ID NO: 32303 - DNA, 3169 bp, Homo sapiens
gcagtgctgctgaccatgagccaccaggtaaagggcctgaaagaggaagcacgaggcggagtgaaagggcgggtgaagagcggctctccacacacaggtgacaggctgggaaggagatcctcaagcaagcgggctctcaaagccgaggggaccccaggcaggcgcggagctcagcgaagccagaaggagcgcgccgggggcagcccaagcccggggtctccccggaggaagcaaacagggcgcaggagacacagagaagagctgggggagcaggagcggggcgaggcagagaggacctgcgagggcaggagaaagcgcgacgagagggcctccttccaggagcggacagcagccccaaagagggaaaaggagattccgaggagggaggagaagtcgaagcggcagaagaaacccaggtcatcctccttggcctccagtgcctctggtggggagtccctgtccgaggaggaactggcccagatcctggagcaggtggaagaaaaaaagaagctcattgccaccatgcggagcaagccctggcccatggcgaagaagctgacagagctcagggaggcccaggaatttgtggagaagtatgaaggtgccttgggaaaggggaaaggcaagcaactatatgcctacaagatgctgatggccaagaaatgggtcaaatttaagagagactttgataatttcaagactcaatgtatcccctgggaaatgaagatcaaggacattgaaagtcactttggttcttcagtggcatcgtatttcatctttctccgatggatgtatggagttaaccttgtcctttttggcttaatatttggtctagtcataatcccagaggtactgatgggcatgccctatgggagtattcccagaaagacagtgcctcgggctgaggaagaaaaggccatggatttttctgtcctttgggattttgagggctatatcaagtactctgcactcttctatggctactacaacaaccagaggaccatcgggtggctgaggtaccggctgcctatggcttactttatggtgggggtcagcgtgttcggctacagcctgattattgtcattcgatcgatggccagcaatacccaaggaagcacaggcgaaggggagagtgacaacttcacattcagcttcaagatgttcaccagctgggactacctgatcgggaattcagagacagctgataacaaatatgcatccatcaccaccagcttcaaggaatcaatagtggatgaacaagagagtaacaaagaagaaaatatccatctgacaagatttcttcgtgtcctggccaactttctcatcatctgctgtttgtgtggaagtgggtacctcatttactttgtggttaagcgatctcagcaattctccaaaatgcagaatgtcagctggtatgaaaggaatgaggtagagatcgtgatgtccctgcttggaatgttttgtccccctctgtttgaaaccatcgctgccctggagaattaccacccacgcactggactgaagtggcagctgggacgcatctttgcactcttcctggggaacctctacacatttctcttggccctgatggatgacgtccacctcaagcttgctaatgaagagacaataaagaacatcactcactggactctgtttaactattacaactcttctggttggaacgagagtgtcccccgaccacccctgcaccctgcagatgtgccccggggttcttgctgggagacagctgtgggcattgaattcatgaggctgacggtgtctgacatgctggtaacgtacatcaccatcctgctgggggacttcctacgggcttgttttgtgcggttcatgaactactgctggtgctgggacttggaggctggatttccttcatatgctgagtttgatattagtggaaatgtgctgggtttgatcttcaaccaaggaatgatctggatgggctccttctatgctccaggcctggtgggcattaatgtgctgcgcctgctgacctccatgtacttccagtgctgggcggtgatgagcagcaacgtaccccatgaacgcgtgttcaaagcctcccgatccaacaacttctacatgggcctcctgctgctggtgctcttcctcagcctcctgccggtggcctacaccatcatgtccctcccaccctcctttgactgcgggccgttcagtgggaaaaacagaatgtacgatgtcctccaagagaccattgaaaacgatttcccaaccttcctgggcaagatctttgctttcctcgccaatccaggcctgatcatcccagccatcctgctgatgttcttggccatttactacctgaactcagtttccaaaagcctttcccgagctaatgcccagctgaggaagaaaatccaagtgctccgtgaagttgagaagagtcacaaatctgtaaaaggcaaagccacagccagagattcagaggacacacctaaaagcagctccaaaaatgccacccagctccaactcaccaaggaagagaccactcctccctctgccagccaaagccaggccatggacaagaaggcgcagggccctgggacctccaattctgccagcaggaccacactgcctgcctctggacaccttcctatatctcggccccctggaatcggaccagattctggccacgccccatctcagactcatccgtggaggtcagcctctggaaagagtgctcagagacctccccactgatggctaggactccagggagcctcgaccctagggctgatcctcaagtaccccagtttcacacataccaaaccaaggttctctcccctctttcctctcacatacatgctctgtctcctctcttggaatgcatgaactttgattccttcaggcccttgtcagctaccgaaggaggaagacagtggcttcacctgtcctttagggaagctggagccatctctgcactaactgccctcccaaatatcttggttcagacagctctgaaccccacgctcacagtggtcgaccttgcctcccgattttcggagttggggaagggccatgaccaccctcgtagactttttccatgggatacagtttaggacacgggtttctgccagcttccctaaccaggagggggatggagaagggcctacatttctcaatccagaggaag

SEQ ID NO: 32304 - DNA, 1838 bp, Homo sapiens
gtgcggctactcccccggccccggcagacctgcgactggcccagtcgcccctggggccctttgccactcccttggcaaggagagccgagacctcagttcccggcggctcttgcggggcacaggtgagccctggctgcgcgcgcggcccctcctccccggcgcctcccagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatggg

SEQ ID NO: 32305 - DNA, 2789 bp, Homo sapiens
aggaagcggaggaaggtgaagtaggaccgaattcctgtgccgaagaggcctgcagtgggagagcaggatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatggg

SEQ ID NO: 32306 - DNA, 2711 bp, Homo sapiens
gtgcggctactcccccggccccggcagacctgcgactggcccagtcgcccctggggccctttgccactcccttggcaaggagagccgagacctcagttcccggcggctcttgcggggcacaggtgagccctggctgcgcgcgcggcccctcctccccggcgcctcccagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatggg

SEQ ID NO: 32307 - DNA, 1046 bp, Homo sapiens
cagtgctgggaggattttgtgggccaggagctgtaccggttcctggtgatggacttcgtcctcatgttgctggacacgctttttggggaactggaaaacaggtttcaaagtgatgtgttttcttcgagaatctgggcctggtggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatggg

SEQ ID NO: 32308 - DNA, 2891 bp, Homo sapiens
gtgcggctactcccccggccccggcagacctgcgactggcccagtcgcccctggggccctttgccactcccttggcaaggagagccgagacctcagttcccggcggctcttgcggggcacaggtgagccctggctgcgcgcgcggcccctcctccccggcgcctcccagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatggg

SEQ ID NO: 32309 - DNA, 1356 bp, Homo sapiens
ctctggttacggacaacatacagaagccactgccaatgagctccgccgagtagcaccggggcagggctagcgcttaaaggagccgcgacccctttgcagaccagagggtgacccggatgatggcggccggcgcggccctagccctggccttgtggctactaatgccaccagtggaggtgggaggggcggggcccccgccaatccaggacggtgagttcacgttcctgttgccggcggggaggaagcagtgtttctaccagtccgcgccggccaacgcaagcctcgagaccgaataccaggtgatcggaggtgctggactggacgtggacttcacgctggagagccctcagggcgtgctgttggtcagcgagtcccgcaaggctgatggggtacacacggtggagccaacggaggccggggactacaagctgtgctttgacaactccttcagcaccatctccgagaagctggtgttctttgaactgatctttgacagcctccaggatgacgaggaggtcgaaggatgggcagaggctgtggagcccgaggagatgctggatgttaaaatggaggacatcaaggagtccattgagaccatgcggacccggctggagcgcagcatccagatgctcacgctactgcgggccttcgaggcacgtgaccgcaacctgcaagagggcaacttggagcgggtcaacttctggtcagctgtcaacgtggcggtgctgctgctggtggctgtgctgcaggtctgcacgctcaagcgcttcttccaggacaagcgcccggtgcccacgtagcccctgccatggaaggaagaacgggacaaaggaggggcagcagggtgtgtgcatatgagacttgggggtccctccccaattttagtttcctgccaaaacgggagtgtgcagtcagggcctgcggtctggccccatgagtctccttccgtcctcagcgggcagggaacacctctggcttgtagaagggacggctcagtggctgcaccgacggtcctggaaatctcacatggtgggcactgcagcgttggaacgtgagcctcggatttcctggcccctctactgtaaatgtgccttagcctaagcctcccatcctgtgttagcgttgcctggtgcggggcagggcctaacaaggaaacctgggccctccaagccaggttgaggtctggtaacagaatgccaggaagggggcctggaagaccacctgccccggcccctctcctgcaggggccccacacaggcatgagggatggcccggccaaagtctaggcagaagcctcctataacaaagggtggtgtggcctgggcattggagtcaataaattatggtcagaaaatc

SEQ ID NO: 32310 - DNA, 1826 bp, Homo sapiens
ggcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagggcatgcacgtggaagtgaaggaccccgacggcaaggtggtgctgtcccggcagtacggctcggagggccgcttcacgttcacctcccacacgcccggtgaccatcaaatctgtctgcactccaattctaccaggatggctctcttcgctggtggcaaactgcgggtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgacccttcctttttacctcatttatttggtactttccccacacagtcctttatccacctggatttttagggaaaaaaatgaaaaagaataagtcacattggttccatggccacaaaccattcagatcagccacttgctgaccctggttcttaaggacacatgacattagtccaatctttcaaaatcttgtcttagggcttgtgaggaatcagaactaacccaggactcagtcctgcttcttttgcctcgagtgattttcctctgtttttcactaaataagcaaatgaaaactctctccattaccttctgctttctctttgtccacttacgcagtaggtgactggcatgtgccacagagcaggccctgcctcactgtctgctggtcagttctgggttcacttaatggctttgtgaatgtaaataaggggcaggtcttggccctagaggattgagatgtttttctaaatcttagaactatttttggataaattatatattttccttcctagtagaagtgttactgcctgtaactagctcaaaataccaatgcagtttctgcattctgggttttgtttttccttttttttttttttttttttttttgagttttgctcttgtcgcccaggctggagtgcaatggcgtgatctcagctcactggcaacatctgcctcccgggttcaaatgattctcctgcctcagtctcctgagtagctgggattacaggtgcccgccaccacgctcagctaatttttgtatttttagtagagatggggttttaccatgttggccaggctggtcttagactcctgacctcagttgatccacctgcctcagcctctgcattcagtttattcacatatttttggtaactcccatggcagctcctaggatttcagcggtctgtgggccagaaagcaggcaccagggctgacctcaaggccgtatcagagggccaagcagagttcttttggatacctgcttttcatcccacagggccttagagtcagaggtaaggtagcaacagagctagaatggggcaatgcactcttaccctccttctcaacttttatttaagctgtgctaaatgttttcttcaagggaaccagatttagttctttacagaattttccagtgaaataaaacatgttgtaat

SEQ ID NO: 32311 - DNA, 2322 bp, Homo sapiens
gcaggcgcagagcgatgcgcaaatgtgcgcaggcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaatctgtctgcactccaattctaccaggatggctctcttcgctggtggcaaactgcgggtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgacccttcctttttacctcatttatttggtactttccccacacagtcctttatccacctggatttttagggaaaaaaatgaaaaagaataagtcacattggttccatggccacaaaccattcagatcagccacttgctgaccctggttcttaaggacacatgacattagtccaatctttcaaaatcttgtcttagggcttgtgaggaatcagaactaacccaggactcagtcctgcttcttttgcctcgagtgattttcctctgtttttcactaaataagcaaatgaaaactctctccattaccttctgctttctctttgtccacttacgcagtaggtgactggcatgtgccacagagcaggccctgcctcactgtctgctggtcagttctgggttcacttaatggctttgtgaatgtaaataaggggcaggtcttggccctagaggattgagatgtttttctaaatcttagaactatttttggataaattatatattttccttcctagtagaagtgttactgcctgtaactagctcaaaataccaatgcagtttctgcattctgggttttgtttttccttttttttttttttttttttttttgagttttgctcttgtcgcccaggctggagtgcaatggcgtgatctcagctcactggcaacatctgcctcccgggttcaaatgattctcctgcctcagtctcctgagtagctgggattacaggtgcccgccaccacgctcagctaatttttgtatttttagtagagatggggttttaccatgttggccaggctggtcttagactcctgacctcagttgatccacctgcctcagcctctgcattcagtttattcacatatttttggtaactcccatggcagctcctaggatttcagcggtctgtgggccagaaagcaggcaccagggctgacctcaaggccgtatcagagggccaagcagagttcttttggatacctgcttttcatcccacagggccttagagtcagaggtaaggtagcaacagagctagaatggggcaatgcactcttaccctccttctcaacttttatttaagctgtgctaaatgttttcttcaagggaaccagatttagttctttacagaattttccagtgaaataaaacatgttgtaatagctgtgtttgagatgaaataagaggttgtgggtagaggggaggcacctaaaggaaaagaggaaaggtgcctgggctacctatgcagataacctggagtggacttcactgtggactcgtggtactaaggcttggcctggacaggcagtctagggggtatgggaatacacggtgtggttgttcaactatttgcaaaggtcaaccaaatagaccacatgttcgcaaagtatcatctgaggaaattaagtaccttcttagccctctcagtcataaatttgaacaaattttaatacacttccctcatgcccttctatataaaacttaataccattagttccccattcttgacattttatttcagtttttattatatatttatttgaaatatttattaaattatctgacctacagaactaaa

SEQ ID NO: 32312 - DNA, 4127 bp, Homo sapiens
ccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagccacctcaagatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacgaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttccaatggctaatgatgttgagtatctttttgtgtgctaatttgccatctatgtatcctcttcggtgaaatgtcttcatgtcttttgtctattttctatttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagttatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcatccaagtagagaaaataatatgtgggttaagatacatccttaaacttttttttttttggggggggggggacggagtcttgctgcaacgcccaggctggagtgcaatggcactatctcagctcgctgcaaccttcacctcctgggttcaagcaattctcctgcctcagcctcctgagtagctgggaatataggtgcacaccaccatgcctggctaatttttgtattttcagtagaagcagagtttcaccatattggccaggttggtctcgaactcctgacctcaagtgatctgcctgcctcagcctcccaaagtgctgggattacacgcgtgagccaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaacc

SEQ ID NO: 32313 - DNA, 1824 bp, Homo sapiens
ggcggcgcgggaacctgacaccgaggatgaataaatgatgctcgctgactacccgtggccaaagcccgtggccaccgagcgccggctggcaggggcagtgaccggcggccggcccgttcgtccctgggctccgcaagcggcgcggtggcacgaagatggcggggtggccgggcgcgggtcccctctgcgtgctgggcggcgccgcactcggggtgtgcctcgcgggggttgccgggcagctggtggagcccagcacggccccacccaagcccaagccgcctccgctgaccaaggagacagtggtgttctgggacatgcgcctgtggcacgtggtgggcatcttttcgctcttcgtgttgtccatcatcatcacgctgtgctgtgtcttcaactgtcgtgtgccacggacccggaaggagatcgaagcccggtacctgcagcgaaaggcagccaagatgtacacagacaagctggagactgtgccacccctcaatgagctcacagaagtcccaggagaggataagaagaagaagaagaagaagaagaaggacagtgtggacacagtggccatcaaagtagaggaggatgagaagaatgaggccaagaagaagaaaggagagaaatgaagacatcctgggcagcttgggctggcgggccctggagctcaagccgtggccggggtccaggcatgttggactctgagctcatttggggaccacagaggctgtggtcagagagggaagctgaggcccatggccacatcctcatggcccatcaggggcaggaaccagacaatctcgtaggtgtcctgccccccagcctaggcttggctcctttcaccccatccacatgggtactgtctcggcagaggtggtctggtgccaccgtccctctgcagatacactgctctccccacccagacctgcctgtctcccaccctttctgccagggatggcagtggctgtgaaggagtaatgggatatggggttacttcagccaccctttctggcacgaaatggctgaagtgcatgggtcagggtgtgaggccacacccagagtagccatgaggaggcagagagggtcactgggggacactgtggcagcaggagggactctgtctggccagggaggagccccagtggtgagaagacttccccaagcctggcaggggatccagctcaagggagtaagtagaggtggcttcagaaatggaacccccagcccagcagacatcaagctcaaggcaatgggctaccctcatttcacacgttgtgatgaagctgaggctgctgccaggcccggcatgaggccccgaggctcgagctcggggctgggggctgcagggctgggtcaggggtacacagagctaaggccaatgggctagagggtgccggaaagagagctggagtctgggctcctcttgggaatcagagtatatttaagaagccaagggggacctcgggctgttctggtggccccttctatgcccagctgtgctgggaggtcccagggccctagaagatcacagcagggccttctgcctgctgaccataacagtgccagcttctttgcagcttcctcttctaccatttcccactacgggcacctaaaagaagcatctctgaccagaagacaaaggcccaaatagcacctgggggagggaagatgcacagaggcacttccagatggcatcgaacagactaaggctctgaaacctaggcctgaacactaaggtctcgagacaccagaggtttctgagccaggagagcctgctggaaaagcagcctgcagagatttgtgaataaagctgattgccttctcaga

SEQ ID NO: 32314 - DNA, 2674 bp, Homo sapiens
aaggcagggggcggggcgtctccgagcggcggggccaagggagggcacaacagctgctacctgaacagtttctgacccaacagttacccagcgccggactcgctgcgccccggcggctctagggacccccggcgcctacacttagctccgcgcccgagagaatgttggaccgacgacacaagacctcagacttgtgttattctagcagctgaacacaccccaggctcttctgcccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagtgtgttagcacgactttccaagtttgaagttgaagatgctgaaaatgttgcttcatatgacagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaaggagacagcagtatttttctgacttatttaacattttagatactgccattattgtgattcttctgctggttgatgtcgtttacattttttttgacattaagttgcttaggaatattcccagatggacacatttacttcgacttctacgacttattattctgttaagaatttttcatctgtttcatcaaaaaagacaacttgaaaagctgataagaaggcgggtttcagaaaacaaaaggcgatacacaagggatggatttgacctagacctcacttacgttacagaacgtattattgctatgtcatttccatcttctggaaggcagtctttctatagaaatccaatcaaggaagttgtgcggtttctagataagaaacaccgaaaccactatcgagtctacaatctatgcagtgaaagagcttacgatcctaagcacttccataatagggtcgttagaatcatgattgatgatcataatgtccccactctacatcagatggtggttttcaccaaggaagtaaatgagtggatggctcaagatcttgaaaacatcgtagcgattcactgtaaaggaggcacagatagaacaggaactatggtttgtgccttccttattgcctctgaaatatgttcaactgcaaaggaaagcctgtattattttggagaaaggcgaacagataaaacccacagcgaaaaatttcagggagtaaaaactccttctcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtctacctctgtatgatgatgtgaaagtgcagtttttctattcgaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatagataaaatgtcagtgtctttcttcttttttgaaggtacatacttcacagtttccatcttgtatttacctaaatttggaacacagtatgcaggaacatcaggcatcattttgaagaactttgaaatagaactttcaaagcaaaaacttgagatattcaaaaattgtgattccccaacacccacttacttacatatttttggtcaagtatttattccctgctttggttcacatttgtaatttcagatttattagaaagctaatttatatatttttcttccccttcatttacaaactgtctgttaacagattggcaaccaagactaagttttaaatccagaagagagaaatgtttcacgcaagcagtcccccaactcccaacacacactccctttcattccgagcactaaataggtagcttacttgacaagcttcctttaattacacacagacatggaggttggggtaagaagatggtggtaaatatgaagataagtaatctttaataacttctgcttttgtataaaattgtaagtgaagtgaaaagaaa

SEQ ID NO: 32315 - DNA, 2036 bp, Homo sapiens
gggagggcacaacagctgctacctgaacagtttctgacccaacagttacccagcgccggactcgctgcgccccggcggctctagggacccccggcgcctacacttagctccgcgcccgagagaatgttggaccgacgacacaagacctcagacttgtgttattctagcagctgaacacaccccaggctcttctgcccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagcagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaaggagacagcagtatttttctgacttatttaacattttagatactgccattattgtgattcttctgctggttgatgtcgtttacattttttttgacattaagttgcttaggaatattcccagatggacacatttacttcgacttctacgacttattattctgttaagaatttttcatctgtttcatcaaaaaagacaacttgaaaagctgataagaaggcgggtttcagaaaacaaaaggcgatacacaagggatggatttgacctagacctcacttacgttacagaacgtattattgctatgtcatttccatcttctggaaggcagtctttctatagaaatccaatcaaggaagttgtgcggtttctagataagaaacaccgaaaccactatcgagtctacaatctatgcagtgaaagagcttacgatcctaagcacttccataatagggtcgttagaatcatgattgatgatcataatgtccccactctacatcagatggtggttttcaccaaggaagtaaatgagtggatggctcaagatcttgaaaacatcgtagcgattcactgtaaaggaggcacagatagaacaggaactatggtttgtgccttccttattgcctctgaaatatgttcaactgcaaaggaaagcctgtattattttggagaaaggcgaacagataaaacccacagcgaaaaatttcagggagtaaaaactccttctcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtctacctctgtatgatgatgtgaaagtgcagtttttctattcgaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatagataaaa

SEQ ID NO: 32316 - DNA, 2150 bp, Homo sapiens
gggagggcacaacagctgctacctgaacagtttctgacccaacagttacccagcgccggactcgctgcgccccggcggctctagggacccccggcgcctacacttagctccgcgcccgagagaatgttggaccgacgacacaagacctcagacttgtgttattctagcagctgaacacaccccaggctcttctgcccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagcccacacacaagtgaatttaaaggagcagcccgggtgtcacctatcagtgaaagtgtgttagcacgactttccaagtttgaagttgaagatgctgaaaatgttgcttcatatgacagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaaggagacagcagtatttttctgacttatttaacattttagatactgccattattgtgattcttctgctggttgatgtcgtttacattttttttgacattaagttgcttaggaatattcccagatggacacatttacttcgacttctacgacttattattctgttaagaatttttcatctgtttcatcaaaaaagacaacttgaaaagctgataagaaggcgggtttcagaaaacaaaaggcgatacacaagggatggatttgacctagacctcacttacgttacagaacgtattattgctatgtcatttccatcttctggaaggcagtctttctatagaaatccaatcaaggaagttgtgcggtttctagataagaaacaccgaaaccactatcgagtctacaatctatgcagtgaaagagcttacgatcctaagcacttccataatagggtcgttagaatcatgattgatgatcataatgtccccactctacatcagatggtggttttcaccaaggaagtaaatgagtggatggctcaagatcttgaaaacatcgtagcgattcactgtaaaggaggcacagatagaacaggaactatggtttgtgccttccttattgcctctgaaatatgttcaactgcaaaggaaagcctgtattattttggagaaaggcgaacagataaaacccacagcgaaaaatttcagggagtaaaaactccttctcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtctacctctgtatgatgatgtgaaagtgcagtttttctattcgaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatagataaaa

SEQ ID NO: 32317 - DNA, 2175 bp, Homo sapiens
ttaccctacatgcctgagaagccagggaccaagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgggacacctccgggccgggcatctccagcccaggcatctccagctggtacacctccaggccgggcatctccaggccgggcatctccagcccaggcatctccagcccaggcatctccagcccgggcatctccggctctggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccaggtacgagcctgcccaagttcacctggcgggagggccagaagcagctaccgctcatcgggtgcgtgctcctcctcattgccctggtggtttcgctcatcatcctcttccagttctggcagggccacacagggatcaggtacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctctctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccgctcacatccaccctgcttgcctccccatgcatggacagacctttagcctcaatgagacctgctggatcacaggctttggcaagaccagggagacagatgacaagacatcccccttcctccgggaggtgcaggtcaatctcatcgacttcaagaaatgcaatgactacttggtctatgacagttaccttaccccaaggatgatgtgtgctggggaccttcgtgggggcagagactcctgccagggagacagcggggggcctcttgtctgtgagcagaacaaccgctggtacctggcaggtgtcaccagctggggcacaggctgtggccagagaaacaaacctggtgtgtacaccaaagtgacagaagttcttccctggatttacagcaagatggagagctcagcgggttgaaaaagggtggacctacaggccaggcaggcagttgctgggcagatgttctcccagaagtatttttttgtgtaaggttgcaatggactttgaaaacgtttcagtttctgcagaggattttgtgatagtttttgttatcaagcatttatgcatgggaatccgctcttcatggcctttcccagctctgtttgttttagtctttttgattttctttttgttgttgttgttgtctttttttaaaaacacaagtgactccattttaactctgacaactttcacagctgtcaccagaatgctccctgagaactaccattctttccctttcccacttaaaatatttcatcagaacctcactactatcataaaagagtataaagtaataaaataataaaaagtta

SEQ ID NO: 32318 - DNA, 1689 bp, Homo sapiens
cactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatggatcctgacagtgatcaacctctgaacagcctcgtcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtgtggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagttggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctataagagaccctcgcagcccagaggcgcccagaggaagtcagcagccctagctcggccacacttggtgctcccagcatcccagggagagacacagcccactgaacaaggtctca

SEQ ID NO: 32319 - DNA, 3054 bp, Homo sapiens
ctgagggagaaggaaagggaccaagagtaggacattgtcaaacatggttttagtctcattttttacaaagaacatgtattaatatgttgtttgtctaattgaaaatgtttatttcttctctttttttcattctgataaatgtctgtcaatgttttatcacattaagtcatttggggaaacatatagttttatattaatttatttgcctgtactctcagaagtgggtatttaaaaaaactattatgtattagtaaattcactatgcttctgtaagatacctgctgttcaacatgaatttatggaatatttcttgagttatatttttattatgtatttagattttaagatctgtttgtttttatctagagcttttatgtgacagtttctttaaaatacttatatacctaccataatcttctttaaattcttaattctagtacattcctaaggtatttctcattctaatctttgtaaccagtttctcctcctttaacaaaattagtccatactaaaaaaatattgctttcttgttgggactatcctgtctctggctttcttcaaggccttctatgggttgaaacttctctgttcagacttgtcaaactagtttcatttcaactacttgtaatttgtttccttatttctttgagccgtagacttctaatacatctagagatgtcatatagttgattagaaagttgagttcagtgggtgcagacctgcaagatcatattcttcctcctgtacatgatgtatcggacagtgggatttggcacccgaagcagaaatctgaagccatggatgattgccgttctcattgtgttgtccctgacagtggtggcagtgaccataggtctcctggttcacttcctagtatttgaccaaaaaaaggagtactatcatggctcctttaaaattttagatccacaaatcaataacaatttcggacaaagcaacacatatcaacttaaggacttacgagagacgaccgaaaatttggtgagtcaggtggatgagatatttatagattcagcctggaagaaaaattatatcaagaaccaagtagtcagactgactccagaggaagatggtgtgaaagtagatgtcattatggtgttccagttcccctctactgaacaaagggcagtaagagagaagaaaatccaaagcatcttaaatcagaagataaggaatttaagagccttgccaataaatgcctcatcagttcaagttaatgcaatgagctcatcaacaggggagttaactgtccaagcaagttgtggtaaacgagttgttccattaaacgtcaacagaatagcatctggagtcattgcacccaaggcggcctggccttggcaagcttcccttcagtatgataacatccatcagtgtggggccaccttgattagtaacacatggcttgtcactgcagcacactgcttccagaagtataaaaatccacatcaatggactgttagttttggaacaaaaatcaaccctcccttaatgaaaagaaatgtcagaagatttattatccatgagaagtaccgctctgcagcaagagagtacgacattgctgttgtgcaggtctcttccagagtcaccttttcggatgacatacgccagatttgtttgccagaagcctctgcatccttccaaccaaatttgactgtccacatcacaggatttggagcactttactatggtggggaatcccaaaatgatctccgagaagccagagtgaaaatcataagtgatgatgtctgcaagcaaccacaggtgtatggcaatgatataaaacctggaatgttctgtgccggatatatggaaggaatttatgatgcctgcaggggtgattctgggggacctttagtcacaagggatctgaaagatacgtggtatctcattggaattgtaagctggggagataactgtggtcaaaaggacaagcctggagtctacacacaagtgacttattaccgaaactggattgcttcaaaaacaggcatctaattcacgataaaagttaaacaaagaaagctgtatgcaggtcatatatgcatgagaattcaactatttagtgggtgtagtacaacaaagtgatattaaattactggatctagtaacatgaaacacacaacgtaagttatttagaatcactttaatcaaccaataatccttagccaatttataagggacttttatttgtaaagtaatggatctggcttgaaaaatacggtagagatacttagctctttaaatcacgaatgttgaagtaccagtgagactcaatacatatttttgaagatagtccatgggatttttagaatgtcgttgtcaagggtctccttttaactgagaaactttttgaactcacaaagtgttcaagaaacccttgtataattccctacatttctctcgagctcacaaatacttttttttctttttccttattcaatcagattttccaaagtacctttccaccataagaaatgaattttctacttctacacccatttgagagacaccaataaaagaaagtcatatgtaggaaacaaagtctgatagtaaaacaagccagagatcttctaactttttttagttataaaacctctaatttttggtgacttttctacacacacacacacatacagtcacatagatattcttatcctacagatataatcagaaaaatcccgattaatgaattatatatagatagatagagtgattagttaatcaaaactatatatttgttaaaaatttgggagaaggtgatggtaatttcattagtcccaaaacaccggcataagaaatttgacatttcacagatgcacttacatattttgaccacaagggggaaattttgtgcattattattgtagggttaaatgcctgaaaaaaataagcatttactaataccttgaaaaatcaaagaacattatgttcctccgtagcaagaaaaattttatgccctcgcattgctacagccaaatagcttataaggcttatggcaatgtcccaactattgcaatcataaaaccctagttttag

SEQ ID NO: 32320 - DNA, 2419 bp, Homo sapiens
aatttgtttccttatttctttgagccgtagacttctaatacatctagagatgtcatatagttgattagaaagttgagttcagtgggtgcagacctgcaagatcatattcttcctcctgtacatgatgtatcggacagtgggatttggcacccgaagcagaaatctgaagccatggatgattgccgttctcattgtgttgtccctgacagtggtggcagtgaccataggtctcctggttcacttcctagtatttgaccaaaaaaaggagtactatcatggctcctttaaaattttagatccacaaatcaataacaatttcggacaaagcaacacatatcaacttaaggacttacgagagacgaccgaaaatttggtggatgagatatttatagattcagcctggaagaaaaattatatcaagaaccaagtagtcagactgactccagaggaagatggtgtgaaagtagatgtcattatggtgttccagttcccctctactgaacaaagggcagtaagagagaagaaaatccaaagcatcttaaatcagaagataaggaatttaagagccttgccaataaatgcctcatcagttcaagttaatgcaatgagctcatcaacaggggagttaactgtccaagcaagttgtggtaaacgagttgttccattaaacgtcaacagaatagcatctggagtcattgcacccaaggcggcctggccttggcaagcttcccttcagtatgataacatccatcagtgtggggccaccttgattagtaacacatggcttgtcactgcagcacactgcttccagaagtataaaaatccacatcaatggactgttagttttggaacaaaaatcaaccctcccttaatgaaaagaaatgtcagaagatttattatccatgagaagtaccgctctgcagcaagagagtacgacattgctgttgtgcaggtctcttccagagtcaccttttcggatgacatacgccagatttgtttgccagaagcctctgcatccttccaaccaaatttgactgtccacatcacaggatttggagcactttactatggtggggaatcccaaaatgatctccgagaagccagagtgaaaatcataagtgatgatgtctgcaagcaaccacaggtgtatggcaatgatataaaacctggaatgttctgtgccggatatatggaaggaatttatgatgcctgcaggggtgattctgggggacctttagtcacaagggatctgaaagatacgtggtatctcattggaattgtaagctggggagataactgtggtcaaaaggacaagcctggagtctacacacaagtgacttattaccgaaactggattgcttcaaaaacaggcatctaattcacgataaaagttaaacaaagaaagctgtatgcaggtcatatatgcatgagaattcaactatttagtgggtgtagtacaacaaagtgatattaaattactggatctagtaacatgaaacacacaacgtaagttatttagaatcactttaatcaaccaataatccttagccaatttataagggacttttatttgtaaagtaatggatctggcttgaaaaatacggtagagatacttagctctttaaatcacgaatgttgaagtaccagtgagactcaatacatatttttgaagatagtccatgggatttttagaatgtcgttgtcaagggtctccttttaactgagaaactttttgaactcacaaagtgttcaagaaacccttgtataattccctacatttctctcgagctcacaaatacttttttttctttttccttattcaatcagattttccaaagtacctttccaccataagaaatgaattttctacttctacacccatttgagagacaccaataaaagaaagtcatatgtaggaaacaaagtctgatagtaaaacaagccagagatcttctaactttttttagttataaaacctctaatttttggtgacttttctacacacacacacacatacagtcacatagatattcttatcctacagatataatcagaaaaatcccgattaatgaattatatatagatagatagagtgattagttaatcaaaactatatatttgttaaaaatttgggagaaggtgatggtaatttcattagtcccaaaacaccggcataagaaatttgacatttcacagatgcacttacatattttgaccacaagggggaaattttgtgcattattattgtagggttaaatgcctgaaaaaaataagcatttactaataccttgaaaaatcaaagaacattatgttcctccgtagcaagaaaaattttatgccctcgcattgctacagccaaatagcttataaggcttatggcaatgtcccaactattgcaatcataaaaccctagttttag

SEQ ID NO: 32321 - DNA, 3247 bp, Homo sapiens
cagacctgcaagatcatattcttcctcctgtacatgatgtatcggacagtgggatttggcacccgaagcagaaatctgaagccatggatgattgccgttctcattgtgttgtccctgacagtggtggcagtgaccataggtctcctggttcacttcctagtatttgaccaaaaaaaggagtactatcatggctcctttaaaattttagatccacaaatcaataacaatttcggacaaagcaacacatatcaacttaaggacttacgagagacgaccgaaaatttggtggatgagatatttatagattcagcctggaagaaaaattatatcaagaaccaagtagtcagactgactccagaggaagatggtgtgaaagtagatgtcattatggtgttccagttcccctctactgaacaaagggcagtaagagagaagaaaatccaaagcatcttaaatcagaagataaggaatttaagagccttgccaataaatgcctcatcagttcaagttaatgcaatgagctcatcaacaggggagttaactgtccaagcaagttgtggtaaacgagttgttccattaaacgtcaacagaatagcatctggagtcattgcacccaaggcggcctggccttggcaagcttcccttcagtatgataacatccatcagtgtggggccaccttgattagtaacacatggcttgtcactgcagcacactgcttccagaagtataaaaatccacatcaatggactgttagttttggaacaaaaatcaaccctcccttaatgaaaagaaatgtcagaagatttattatccatgagaagtaccgctctgcagcaagagagtacgacattgctgttgtgcaggtctcttccagagtcaccttttcggatgacatacgccagatttgtttgccagaagcctctgcatccttccaaccaaatttgactgtccacatcacaggatttggagcactttactatggtggggaatcccaaaatgatctccgagaagccagagtgaaaatcataagtgatgatgtctgcaagcaaccacaggtgtatggcaatgatataaaacctggaatgttctgtgccggatatatggaaggaatttatgatgcctgcaggggtgattctgggggacctttagtcacaagggatctgaaagatacgtggtatctcattggaattgtaagctggggagataactgtggtcaaaaggacaagcctggagtctacacacaagtgacttattaccgaaactggattgcttcaaaaacaggcatctaattcacgataaaagttaaacaaagaaagctgtatgcaggtcatatatgcatgagaattcaactatttagtgggtgtagtacaacaaagtgatattaaattactggatctagtaacatgaaacacacaacgtaagttatttagaatcactttaatcaaccaataatccttagccaatttataagggacttttatttgtaaagtaatggatctggcttgaaaaatacggtagagatacttagctctttaaatcacgaatgttgaagtaccagtgagactcaatacatatttttgaagatagtccatgggatttttagaatgtcgttgtcaagggtctccttttaactgagaaactttttgaactcacaaagtgttcaagaaacccttgtataattccctacatttctctcgagctcacaaatacttttttttctttttccttattcaatcagattttccaaagtacctttccaccataagaaatgaattttctacttctacacccatttgagagacaccaataaaagaaagtcatatgtaggaaacaaagtctgatagtaaaacaagccagagatcttctaactttttttagttataaaacctctaatttttggtgacttttctacacacacacacacatacagtcacatagatattcttatcctacagatataatcagaaaaatcccgattaatgaattatatatagatagatagagtgattagttaatcaaaactatatatttgttaaaaatttgggagaaggtgatggtaatttcattagtcccaaaacaccggcataagaaatttgacatttcacagatgcacttacatattttgaccacaagggggaaattttgtgcattattattgtagggttaaatgcctgaaaaaaataagcatttactaataccttgaaaaatcaaagaacattatgttcctccgtagcaagaaaaattttatgccctcgcattgctacagccaaatagcttataaggcttatggcaatgtcccaactattgcaatcataaaaccctagttttagaaaaatttgaaaataaatataaaatttgagcacctactgcatataacacatggggctataacatataacatatagtatgttttctcttttggaccactttgttatatgtggtccacaagagaaaacatactccatcagcaacgtgtctcctgaagtcattaggagagtaaggctcatgtatttcgtaatacaattaaattaaggctttatggaagcaattattctgcttggcaatgcctgtgaaatattatggtctgcaggctggggagtcatttactcatttagcccaaatataagacaaatcattggaacgatgaacttgctttataataatttccctcacatgctattgagaaggcatgaaaataatcctaaaatatctaaaagagatatgcagttcactcataaaacacttgattcataatttagactcatagaattttaaagctgagaagagattgcatgtcacataggccaatatacttatgttatgtttaagaatatgagtatattcttaactatttttattgaattcttaactatttttattgaatcatcagatctgtaaaattttaagtgagagctattgaacctgtattaagatagaaaactcttaagataagaattttaaatgacgagattcatttaggcagctggctgccaattctctgaattcacttcaagacaaagtttcttcttcatatataaatatacataggcatataaattattctatattatggtggtaaaacttaatgctgactttggatgttcagattcaggaaatgatcttagaattatgaactttgtatttttaaactatttggtgcagcatttcattttgggtcacatgtaagcagatattgatatgtcatttttaatctaataaagttggtgatcagagcattctacaaac

SEQ ID NO: 32322 - DNA, 3266 bp, Homo sapiens
tgagaagccagggaccaagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgggacacctccgggccgggcatctccagcccaggcatctccagctggtacacctccaggccgggcatctccaggccgggcatctccactccaggcatctccagcccgggcatctccggctctggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccaggtacgagcctgcccaagttcacctggcgggagggccagaagcagctaccgctcatcgggtgcgtgctcctcctcattgccctggtggtttcgctcatcatcctcttccagttctggcagggccacacagggatcaggtacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctctctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccgctcacatccaccctgcttgcctccccatgcatggacagacctttagcctcaatgagacctgctggatcacaggctttggcaagaccagggagacagatgacaagacatcccccttcctccgggaggtgcaggtcaatctcatcgacttcaagaaatgcaatgactacttggtctatgacagttaccttaccccaaggatgatgtgtgctggggaccttcgtgggggcagagactcctgccagggagacagcggggggcctcttgtctgtgagcagaacaaccgctggtacctggcaggtgtcaccagctggggcacaggctgtggccagagaaacaaacctggtgtgtacaccaaagtgacagaagttcttccctggatttacagcaagatggagagcgaggtgcgattcagaaaatcctaaccagctggcctgctgctctgcacagcaccggctgctgtgaagactctggccatggtgactggccatgtgtggcatcatctgggctaatggccaccgggcaccatcggactcccacctccactgtctgctgcctctgtgtgtgtgtgtgtgtgtgtgtgtgtgtgtgcatatgtgtgcattgccactctcccaagtttttcagaaaccagcagagctgtcaactcttctcaaaatcccaggctggaaattacctggagacaagagttgagtaccgtggatgttcctacaggagtgtccatagatggatggaggaggtggagcccagagcccaaggaagagctgggaattcttgcttctctgaccctcacttacagactagcccagtgtgggcagatgccagcggcccaggtggcgccattgctgtcctgggatggatcgtgggttttggtggatgcagcttcccagggcctggaccgtcttcggtgaaaagctgctcccgttggctttatgagcatcaagtcctcacccagaccccctgctggtgccgtggatgtcaccagtcggactgtgctgtggctaaccaggctgacaactgagatgaggattcactgtactcatttggtcacaagctgctggggcgggttttattttattttatttttatatttaagaaatgaaaatacgggtatttttaaagattctccaaaaagtccagaagccttgacagctggcatcaatcagcccaagacccccaggggattcatgggaaatgtcgtattttagagtcctacagaatatttctggcctcaaggaactggatgaagagactggacaaagtccccaggatgggcatcccccaagtcactacagcatctggagcccctaggagatactcagggaagcaaatccttgtttgggctggcaagcaaatccgacacgacgaggtccacaaactgtttctgcatcccagggctctgacgaaggcgttaagaaacagatgctgttcccgcgtaggctcccaggggccccagggaggtccaggtggactgcctctctcattcccagtagctgtcctgggactttgggatttcttctcagctttctccacctttcagtttctcagttgtttcagaaacatagcaatgacataaaaactgctatggagagaaagctaacatggtcccatgccttccaggcagccctgctgaaggatctaagttggccctgttcctgcaaatcatcaacgtgcctggactcgccagctaaaagcctgggccttccccagccttttttctggggcacctattcctctgccagtcctgctcccctcaccttccttgggcccgtcagagtcttttgtggtgctgtgcttctcagaggcaggatccaagcagatcagcccagcctagcccagctcaggcaggccatggccgctcaagggaaagactgccccagaagagcaagctggagaggctgggcaggggctgatggggctgggtacac

SEQ ID NO: 32323 - DNA, 2361 bp, Homo sapiens
tgagaagccagggaccaagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgggacacctccgggccgggcatctccagcccaggcatctccagctggtacacctccaggccgggcatctccaggccgggcatctccagcccaggcatctccagcccaggcatctccagcccgggcatctccggctctggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccaggtacgagcctgcccaagttcacctggcgggagggccagaagcagctaccgctcatcgggtgcgtgctcctcctcattgccctggtggtttcgctcatcatcctcttccagttctggcagggccacacagggatcaggtacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctctctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccgctcacatccaccctgcttgcctccccatgcatggacagacctttagcctcaatgagacctgctggatcacaggctttggcaagaccagggagacagatgacaagacatcccccttcctccgggaggtgcaggtcaatctcatcgacttcaagaaatgcaatgactacttggtctatgacagttaccttaccccaaggatgatgtgtgctggggaccttcgtgggggcagagactcctgccagggagacagcggggggcctcttgtctgtgagcagaacaaccgctggtacctggcaggtgtcaccagctggggcacaggctgtggccagagaaacaaacctggtgtgtacaccaaagtgacagaagttcttccctggatttacagcaagatggaggtaagatccctgcagcaggacactgcacccagcaggctgggaacttcctcaggtggggaccctggaggagcacccaggttgtaggcagaggtcccctcagcgtccccatattcggggggtgttctggacagggtcaaatgtgatgcctggggtcaatcccagctgtctgtgtttctttccctgcttttcttccctcagaacagagctcagcgggttgaaaaagggtggacctacaggccaggcaggcagttgctgggcagatgttctcccagaagtatttttttgtgtaaggttgcaatggactttgaaaacgtttcagtttctgcagaggattttgtgatagtttttgttatcaagcatttatgcatgggaatccgctcttcatggcctttcccagctctgtttgttttagtctttttgattttctttttgttgttgttgttgtctttttttaaaaacacaagtgactccattttaactctgacaactttcacagctgtcaccagaatgctccctgagaactaccattctttccctttcccacttaaaatatttcatcagaacctcactactatcataaaagagtataaagtaataaaataataaaaag

SEQ ID NO: 32324 - DNA, 1950 bp, Homo sapiens
aagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgggacacctccgggccgggcatctccagcccaggcatctccagctggtacacctccaggccgggcatctccaggccgggcatctccagcccaggcatctccagcccaggcatctccagcccgggcatctccggctctggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccaggtacgagcctgcccaagttcacctggcgggagggccagaagcagctaccgctcatcgggtgcgtgctcctcctcattgccctggtggtttcgctcatcatcctcttccagttctggcagggccacacagggatcaggtacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctctctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccgctcacatccaccctgcttgcctccccatgcatggacagacctttagcctcaatgagacctgctggatcacaggctttggcaagaccagggagacagatgacaagacatcccccttcctccgggaggtgcaggtcaatctcatcgacttcaagaaatgcaatgactacttggtctatgacagttaccttaccccaaggatgatgtgtgctggggaccttcgtgggggcagagactcctgccagggagacagcggggggcctcttgtctgtgagcagaacaaccgctggtacctggcaggtgtcaccagctggggcacaggctgtggccagagaaacaaacctggtgtgtacaccaaagtgacagaagttcttccctggatttacagcaagatggagagcgaggtgcgattcagaaaatcctaaccagctggcctgctgctctgcacagcaccggctgctgtgaagactctggccatggtgactggccatgtgtggcatcatctgggctaatggccaccgggcaccatcggactcccacctccactgtctgctgcctctgtgtgtgtgtgtgtgtgtgtgtgtgtgtgtgcatatgtgtgcattgccactct

SEQ ID NO: 32325 - DNA, 2592 bp, Homo sapiens
cacacgtcccaaccggcttccccgccccatttggtgggggctggcccttggccctccaactcctttaccctacatgcctgagaagccagggaccaagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgggacacctccgggccgggcatctccagcccaggcatctccagctggtacacctccaggccgggcatctccaggccgggcatctccagcccaggcatctccagcccaggcatctccagcccgggcatctccggctctggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccaggtacgagcctgcccaagttcacctggcgggagggccagaagcagctaccgctcatcgggtgcgtgctcctcctcattgccctggtggtttcgctcatcatcctcttccagttctggcagggccacacagggatcaggtacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctctctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccggtgagggaatctgcactccccgctctcctgccccccagccccagcaccctctgcagccctcgcacttgtcagcatctgtcaactcatatccgggccccaaagcttctgcagggcagaagtcaaagactcttaaagatccttacatggaacacttctgttttataattagggaaactgaagcccaagggttataaataagtttgctccaaatgacacatctcacattacaaattgatgacggagtcagggcttgggtactgatcttaatcaatagattgaattctttcactggtattaactgagcacctaggggccaaacgctatggtaggcatttcacacatatgatttcatttactcttcacaaccaaccctgtggagcaggcactattattaacttcatttgacatatgaggaaatggagctttacagagagataattacctgaggccacaagtaataggtggtagctctgggattggaaccaggtcgatctgattcccaagcagtgctctccccacctggctctagactggcaaattgcttaccctgcagtcgagaacttaagctgagtacacattcaaacaactaattgctacaacgttgttgctaaggaccaaaggaggctacacaaaggaaatgctgcagaggttctcagaagatcactgtggacaggggacgtcaaagaagacttcattcattcattcattcattcactcatcattcatccattcactcatttgttcacttatcaaatactatatggccagccctatagtacagttgcaaatagaaataaaatacaccaagacgaccagtagaggccaattatacgatgttttcggggagcagggagctatggtggcataggcgggagcaactaatcatcctggcaggctaggggaagctcagcagaggaaggatagccaaggtgggtcccgaaaagattggagaagacaggtaatgggggctcagggaggaccctgaagaatggagccagagccctctggcataagcatctgtaaaggtgggagagggaggaggagtaccgggatttctggaagcctcggaggactctctggttagtccagccattctcgtgctctgagcctgtgagctggtgtttcctcgcacattaattatggaggcggtgtctatca

SEQ ID NO: 32326 - DNA, 3269 bp, Homo sapiens
tgagaagccagggaccaagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgggacacctccgggccgggcatctccagcccaggcatctccagctggtacacctccaggccgggcatctccaggccgggcatctccagcccaggcatctccagcccaggcatctccagcccgggcatctccggctctggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccagtccagttctggcagggccacacagggatcaggtacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctctctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccgctcacatccaccctgcttgcctccccatgcatggacagacctttagcctcaatgagacctgctggatcacaggctttggcaagaccagggagacagatgacaagacatcccccttcctccgggaggtgcaggtcaatctcatcgacttcaagaaatgcaatgactacttggtctatgacagttaccttaccccaaggatgatgtgtgctggggaccttcgtgggggcagagactcctgccagggagacagcggggggcctcttgtctgtgagcagaacaaccgctggtacctggcaggtgtcaccagctggggcacaggctgtggccagagaaacaaacctggtgtgtacaccaaagtgacagaagttcttccctggatttacagcaagatggagagcgaggtgcgattcagaaaatcctaaccagctggcctgctgctctgcacagcaccggctgctgtgaagactctggccatggtgactggccatgtgtggcatcatctgggctaatggccaccgggcaccatcggactcccacctccactgtctgctgcctctgtgtgtgtgtgtgtgtgtgtgtgtgtgtgtgcatatgtgtgcattgccactctcccaagtttttcagaaaccagcagagctgtcaactcttctcaaaatcccaggctggaaattacctggagacaagagttgagtaccgtggatgttcctacaggagtgtccatagatggatggaggaggtggagcccagagcccaaggaagagctgggaattcttgcttctctgaccctcacttacagactagcccagtgtgggcagatgccagcggcccaggtggcgccattgctgtcctgggatggatcgtgggttttggtggatgcagcttcccagggcctggaccgtcttcggtgaaaagctgctcccgttggctttatgagcatcaagtcctcacccagaccccctgctggtgccgtggatgtcaccagtcggactgtgctgtggctaaccaggctgacaactgagatgaggattcactgtactcatttggtcacaagctgctggggcgggttttattttattttatttttatatttaagaaatgaaaatacgggtatttttaaagattctccaaaaagtccagaagccttgacagctggcatcaatcagcccaagacccccaggggattcatgggaaatgtcgtattttagagtcctacagaatatttctggcctcaaggaactggatgaagagactggacaaagtccccaggatgggcatcccccaagtcactacagcatctggagcccctaggagatactcagggaagcaaatccttgtttgggctggcaagcaaatccgacacgacgaggtccacaaactgtttctgcatcccagggctctgacgaaggcgttaagaaacagatgctgttcccgcgtaggctcccaggggccccagggaggtccaggtggactgcctctctcattcccagtagctgtcctgggactttgggatttcttctcagctttctccacctttcagtttctcagttgtttcagaaacatagcaatgacataaaaactgctatggagagaaagctaacatggtcccatgccttccaggcagccctgctgaaggatctaagttggccctgttcctgcaaatcatcaacgtgcctggactcgccagctaaaagcctgggccttccccagccttttttctggggcacctattcctctgccagtcctgctcccctcaccttccttgggcccgtcagagtcttttgtggtgctgtgcttctcagaggcaggatccaagcagatcagcccagcctagcccagctcaggcaggccatggccgctcaagggaaagactgccccagaagagcaagctggagaggctgggcaggggctgatggggctgggtacactggggaatgttagcaagactgggaaggaggccacattcctgtctgcagcagccgccagcgatggtcttcagcaataaaagttgtgtgacctga

SEQ ID NO: 32327 - DNA, 3193 bp, Homo sapiens
ttctgcttttaatgatggcagctccagaaatggtgagtaaaatgggtgtgaggagagaagatgcttctcaacacttctcagtgttgtacagcttgccaaccacagcctgtttgggaggggatgttctcacccaggttccatctttcagaagccatttgcccacttattctttttatatggataaacgatgtaatttgctacatgctgataataaacagaggtatcagcaagaatgaaagccagaaaatggcccaacatgaacttcttgcttttctaagttactctttcaagctcttcttgcgatagaaatgaaatgaacatttttggcacagaactcttgtttagattttactatgatcttgggaaacacgggttgcttcaaatggcttactagatccctttggaatttcaaacgttacaacaggtagtcacaaagggaatgaaagcggatgatctgagtgtctgtgctgatgtgcctgctggagcccctgtggattttagcccttggaggaagcaggttcccagagcagccatgcctgatatctgggagagggaactagaatttaattgggaatcttctgctatttccctgcttcctccgccctctcagagttacagggaatgacttagaaaggtctctggtctccttggcattgtgataggtggaattctttcgtaggaaacacagccccggggttattttgatgcaagccgttggtccaaagccactccccactttgctatgtgggggaaggaccgggcaccggacggctcgggtactttcgttcttaattaggtcatgcccgtgtgagccaggaaagggctgtgtttatgggaagccagtaacactgtggcctactatctcttccgtggtgccatctacatttttgggactcgggaattatgaggtagaggtggaggcggagccggatgtcagaggtcctgaaatagtcaccatgggggaaaatgatccgcctgctgttgaagcccccttctcattccgatcgctttttggccttgatgatttgaaaataagtcctgttgcaccagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatgaaatgatccagcctgtgtgcctgcccaactctgaagagaacttccccgatggaaaagtgtgctggacgtcaggatggggggccacagaggatggagcaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccagggggacagcggggggcccctggtgtgtcaagagaggaggctgtggaagttagtgggagcgaccagctttggcatcggctgcgcagaggtgaacaagcctggggtgtacacccgtgtcacctccttcctggactggatccacgagcagatggagagagacctaaaaacctgaagaggaaggggacaagtagccacctgagttcctgaggtgatgaagacagcccgatcctcccctggactcccgtgtaggaacctgcacacgagcagacacccttggagctctgagttccggcaccagtagcaggcccgaaagaggcacccttccatctgattccagcacaaccttcaagctgctttttgttttttgtttttttgagatggagtctcgctctgttgcccaggctggagtgcagtggcgaaatccctgctcactgcagcctccgcttccctggttcaagcgattctcttgcctcagcttccccagtagctgggaccacaggtgcccgccaccacacccaactaatttttgtatttttagtagagacagggtttcaccatgttggccaggctgctctcaaacccctgacctcaaatgatgtgcctgcttcagcctcccacagtgctgggattacaggcatgggccaccacgcctagcctcacgctcctttctgatcttcactaagaacaaaagaagcagcaacttgcaagggcggcctttcccactggtccatctggttttctctccaggggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctca

SEQ ID NO: 32328 - DNA, 3192 bp, Homo sapiens
ttctgcttttaatgatggcagctccagaaatggtgagtaaaatgggtgtgaggagagaagatgcttctcaacacttctcagtgttgtacagcttgccaaccacagcctgtttgggaggggatgttctcacccaggttccatctttcagaagccatttgcccacttattctttttatatggataaacgatgtaatttgctacatgctgataataaacagaggtatcagcaagaatgaaagccagaaaatggcccaacatgaacttcttgcttttctaagttactctttcaagctcttcttgcgatagaaatgaaatgaacatttttggcacagaactcttgtttagattttactatgatcttgggaaacacgggttgcttcaaatggcttactagatccctttggaatttcaaacgttacaacaggtagtcacaaagggaatgaaagcggatgatctgagtgtctgtgctgatgtgcctgctggagcccctgtggattttagcccttggaggaagcaggttcccagagcagccatgcctgatatctgggagagggaactagaatttaattgggaatcttctgctatttccctgcttcctccgccctctcagagttacagggaatgacttagaaaggtctctggtctccttggcattgtgataggtggaattctttcgtaggaaacacagccccggggttattttgatgcaagccgttggtccaaagccactccccactttgctatgtgggggaaggaccgggcaccggacggctcgggtactttcgttcttaattaggtcatgcccgtgtgagccaggaaagggctgtgtttatgggaagccagtaacactgtggcctactatctcttccgtggtgccatctacatttttgggactcgggaattatgaggtagaggtggaggcggagccggatgtcagaggtcctgaaatagtcaccatgggggaaaatgatccgcctgctgttgaagcccccttctcattccgatcgctttttggccttgatgatttgaaaataagtcctgttgcaccagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatgaaatgatccagcctgtgtgcctgcccaactctgaagagaacttccccgatggaaaagtgtgctggacgtcaggatggggggccacagaggatggagcaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccagggggacagcggggggcccctggtgtgtcaagagaggaggctgtggaagttagtgggagcgaccagctttggcatcggctgcgcagaggtgaacaagcctggggtgtacacccgtgtcacctccttcctggactggatccacgagcagatggagagagacctaaaaacctgaagaggaaggggacaagtagccacctgagttcctgaggtgatgaagacagcccgatcctcccctggactcccgtgtaggaacctgcacacgagcagacacccttggagctctgagttccggcaccagtagcaggcccgaaagaggcacccttccatctgattccagcacaaccttcaagctgctttttgttttttgtttttttgagatggagtctcgctctgttgcccaggctggagtgcagtggcgaaatccctgctcactgcagcctccgcttccctggttcaagcgattctcttgcctcagcttccccagtagctgggaccacaggtgcccgccaccacacccaactaatttttgtatttttagtagagacagggtttcaccatgttggccaggctgctctcaaacccctgacctcaaatgatgtgcctgcttcagcctcccacagtgctgggattacaggcatgggccaccacgcctagcctcacgctcctttctgatcttcactaagaacaaaagaagcagcaacttgcaagggcggcctttcccactggtccatctggttttctctccaggggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctc

SEQ ID NO: 32329 - DNA, 1342 bp, Homo sapiens
accgggcaccggacggctcgggtactttcgttcttaattaggtcatgcccgtgtgagccaggaaagggctgtgtttatgggaagccagtaacactgtggcctactatctcttccgtggtgccatctacatttttgggactcgggaattatgaggtagaggtggaggcggagccggatgtcagaggtcctgaaatagtcaccatgggggaaaatgatccgcctgctgttgaagcccccttctcattccgatcgctttttggccttgatgatttgaaaataagtcctgttgcaccagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatggtacatctgggtctctatgtggttctgcagctcttcctttgtttcaagaggatttgcaattgctcattgaagcattcttatgatggctgctttataatccttgtcagatattaataattccaactcctgattcatgttggtgttggcatcagttgattatcttttctcattaaaattgtgatgctccta

SEQ ID NO: 32330 - DNA, 2403 bp, Homo sapiens
cttaattaggtcatgcccgtgtgagccaggaaagggctgtgtttatgggaagccagtaacactgtggcctactatctcttccgtggtgccatctacatttttgggactcgggaattatgaggtagaggtggaggcggagccggatgtcagaggtcctgaaatagtcaccatgggggaaaatgatccgcctgctgttgaagcccccttctcattccgatcgctttttggccttgatgatttgaaaataagtcctgttgcaccagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatgaaatgatccagcctgtgtgcctgcccaactctgaagagaacttccccgatggaaaagtgtgctggacgtcaggatggggggccacagaggatggaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccagggggacagcggggggcccctggtgtgtcaagagaggaggctgtggaagttagtgggagcgaccagctttggcatcggctgcgcagaggtgaacaagcctggggtgtacacccgtgtcacctccttcctggactggatccacgagcagatggagagagacctaaaaacctgaagaggaaggggacaagtagccacctgagttcctgaggtgatgaagacagcccgatcctcccctggactcccgtgtaggaacctgcacacgagcagacacccttggagctctgagttccggcaccagtagcaggcccgaaagaggcacccttccatctgattccagcacaaccttcaagctgctttttgttttttgtttttttgagatggagtctcgctctgttgcccaggctggagtgcagtggcgaaatccctgctcactgcagcctccgcttccctggttcaagcgattctcttgcctcagcttccccagtagctgggaccacaggtgcccgccaccacacccaactaatttttgtatttttagtagagacagggtttcaccatgttggccaggctgctctcaaacccctgacctcaaatgatgtgcctgcttcagcctcccacagtgctgggattacaggcatgggccaccacgcctagcctcacgctcctttctgatcttcactaagaacaaaagaagcagcaacttgcaagggcggcctttcccactggtccatctggttttctctccaggggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctca

SEQ ID NO: 32331 - DNA, 2074 bp, Homo sapiens
acacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtgtggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagttggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctataagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggcata

SEQ ID NO: 32332 - DNA, 2052 bp, Homo sapiens
gagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtgtggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagttggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctataagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggca

SEQ ID NO: 32333 - DNA, 5550 bp, Homo sapiens
gtagggctgttttaatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtgtggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagttggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctataagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggcataggctagctggaatgcttgataagaactgagctgggatgattgaactttcattctttggcttggggagaaaagaagtcctggggaagcaattgagtctcaaagtagaggcaggggaaaaaagagttagggagaccagatctgctgagtggcagcaagagtgagctgcagattacagaaaccagggtgagcaagtttgagtcccacacagggccttctccctttgcctctttccctccctccctgcctgtgataatcagccaggagccagggataacctatgacttgggaaagagatgagttaggcagtcaagggtgacattcaatcagggatccacaagtggctggaaagaaatgctggtcctgtgtcctaactttttccgcctggagagccctcagtgtggcttcttacatttaaaaaacaaaaaggatcagctgccaggtgtgaggcagtccccaagctgagttgtgaggatgtaagcatgaataagtccctgcactcaaaatggtcaaagaattaaaccccatggacttttttggcatctgtatgaaagcttgggttttctgaggactgtcttgctatagttaagtcagatcctagatgaaatatacttgttcatactgtactaggttcttaggaaacaacagaattcctcaaatgccaaaaacaaagaaaatagaaacccagaaaacaaaacaaaataaaacaaaaccatcagaactgtgagtggaaactaaggtgatgatctgggagcaatacactaaaatcttgggtcgagacctatatgaaggctggcagtggagctaaacctggacacactgaagacaagggagctgaaccagggctcctacatgaagcagggataactgatggcagtaaatgtggtctcaaattgcagatggtctggaggaaaatttcccaaatttagagcctcaggattcccaaagatcctccaaatatgagctcacaatcaaagatcagagacgttgaaaaataaaaaacaccttaagtgggcagcataaaaaacagctaatttagaaccccaaaggcttcagatgtcagaatattagagacttatgataataagcaatatttgcagagtatttgtatgtgccagacactattgtaagtgcttcatcatgtactgattcatttaatactcacagaaatctgtgagatgggtattattcttatcctcactctatggattaaaaaaactaaggcacaaagtggttaagctccttgcctgagattatagactgtaagttgaacgtgagcacttggaatacagagttcatgctgtaaactaccacactatagggcctccaatatgataatttataaaatatttgaataaaaaatgaatactagttccacattttaaaatcatgtttaactgtggtcaaatgcacataacacaagttgccatcttcaccatttttaggtgtatagttcagtggtgttatgtacattcacactattgtgcagtcatcaccaccatccatctccagaacagaaactcagtacccatcaaacaactctccatttccccctcctcccaatctctggcaaccaccattgtgctttcagtctctgtgaactggattactctgggtacctcatttaagtgaagtcatgcagtattggtctttttgtacttgttttatttcacttcacattgtgtcttcaagtttcacccatgttgtagcatgtgtcagaatttcttccctttttagactaaataatattctattgtttatacgaacattcaggttacttctatcttttggctattgtgaattatgctgctgtgaacatgggtgtacaagtatctctttgaggccctgctttcaattctcttgggtatattcccagaagtggaattgctggatcatatggtaattctattttgaattttttgaggaactgatatattgctttccatagagactgcaccattttacattcccatcaacagtttgcaggagttactatttctccatatcccccctaacacttgctattttctgttaaaaatggatatcttaataatcaagcaaaaataacaggcagatttgaaaaagaactgaatacagcttttagaaataaaaactataattataaaaataaaaaactaagtggatggggtaaataacaattaaaacaccaattaagagagaacaaatgaactggaagataaattgaagaagtgactaggcttaacagcagagagagataaggagattaaaaatatgaaaacaaggccaggagcaatgaagcctagaatggtaaattctaacatatccagaatcccagaaagagagaatcaagacaatgagagagagacagtaccaaagagataagagctgagaatgttccagaattgataaaaggtgtgaatccacagaacatacaccaccatagtgtacacgcatacaaccaaggtggaaaaattagaataaatccacacctatgtacattataatgaaactgcagaacaccaaagacaaaaagaaactccttatagcagcagagagaaaacccagaccacccacagtaccacaaatctaccacaattagactgacaacaggctttcccacagcaataaaggagctagaagtcagtggaagtatatctccagcatgccaaaagataacaatcaatcagggattgtgaaccctacaaaactatctttcaagaataaaggcattttcaagaaaacaaaaacagactttaccatcaacaaaccttctctaaaagaatatataaagcatttactttaggaagaaggaaaatgatcctaaaaggaagaaccaagaagcaagtagcaatagtgaggcaattgtgaaaatgtaggtaagtctaaacacactctgtctacttcttcttcttcttcttcttcttcttcttcttattttgagactgagtcttgccctgtcacccagactggagtgcagtggcaggatcttggctcactgctatctccacctcccaggttcaagtgattcttctgcctcagcctcccgagtagctgggattacatgcacatgccaccatatccggctaatttttgaatttttagtagagatggggtttcactgtgttggccaggccggtctcaaactcccgacctcaagtgatccccccgcctcggcctcccaaagtgctgggattacaggcgtgtctacatattattaaaataacaataatatttattttgtgggttaattttttttgaaacagatattgaatttattggttggctatgagtagaaaaatacatcagtaaagaaaaaagaccctgtatataaatataatactagctagttaaaatttgaccaagaagtttccattgtgggttaatttttaaaggcctaactgaaatatggagtaaccacagcatgcagcatgtaaattaaaggggatagctgg

SEQ ID NO: 32334 - DNA, 2232 bp, Homo sapiens
gggatacagggaggggccatgtgcgaaccagggagacctcatcttccaaccaagcttgctgggctagctttaatcaatgctggcctgagaacaggagcggaacattgcctagtagaccctgaggctttacaacagtgccactgacccctatgagcctgatgctggatgaccaaccccctatggaggcccagtatgcagaggagggcccaggacctgggatcttcagagcagagcctggagaccagcagcatcccatttctcaggcagtgtgctggcgttccatgcgacgtggctgtgcagtgctgggagccctggggctgctggccggtgcaggtgttggctcatggctcctagtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtggctgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacaggtctctcctcttgggccctgatttcagagtcctctttctcactagagactcaatgacagaagagaggctgggacttggttgggcatgctgtggttgctgagggatgagggggaggagagaggtaggagctggagatgaagaggctgctagaagcagcaggaagcctgcccttctgccctctcccctccctgcccctgtgtgagtcttttgggagggtgctgggaggtgccccccgtcccacctttttcctgtgctctaggtgggctaagtgcctccctagaggactccatggctgagaggctcctgggcagatggggtcaaggctgggccagcccagatgaagcctatgggagtcaggaccctctccactctccctctccactccccttcctgttctcacctggctgtggctggccctgtgtggggtgggtacactggaaaacaagaaggttggagttggtctaggacattggttttaaatgacagttctgtgaactggtccaaggagttctgttattaaagtgatatatggtcttg

SEQ ID NO: 32335 - DNA, 3194 bp, Homo sapiens
gttcttgagccagacccagtccagctctggtgcctgccctctggtgcgagctgacctgagatgcacttccctcctctgtgagctgtctcggcacccacttgcagtcactgccgcctgatgttgttactcttccactccaaaaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttggggagggacccctcacctgcttcttctggttcattctccaaatccccgagcaccgccggctgatgctgagccccgaggtggtgcaggcactgctggtggaggagctgctgtccacagtcaacagctcggctgccgtcccctacagggccgagtacgaagtggaccccgagggcctagtgatcctggaagccagtgtgaaagacatagctgcattgaattccacgctgggttgttaccgctacagctacgtgggccagggccaggtcctccggctgaaggggcctgaccacctggcctccagctgcctgtggcacctgcagggccccaaggacctcatgctcaaactccggctggagtggacgctggcagagtgccgggaccgactggccatgtatgacgtggccgggcccctggagaagaggctcatcacctcggtgtacggctgcagccgccaggagcccgtggtggaggttctggcgtcgggggccatcatggcggtcgtctggaagaagggcctgcacagctactacgaccccttcgtgctctccgtgcagccggtggtcttccaggcctgtgaagtgaacctgacgctggacaacaggctcgactcccagggcgtcctcagcaccccgtacttccccagctactactcgccccaaacccactgctcctggcacctcacggtgccctctctggactacggcttggccctctggtttgatgcctatgcactgaggaggcagaagtatgatttgccgtgcacccagggccagtggacgatccagaacaggaggctgtgtggcttgcgcatcctgcagccctacgccgagaggatccccgtggtggccacggccgggatcaccatcaacttcacctcccagatctccctcaccgggcccggtgtgcgggtgcactatggcttgtacaaccagtcggacccctgccctggagagttcctctgttctgtgaatggactctgtgtccctgcctgtgatggggtcaaggactgccccaacggcctggatgagagaaactgcgtttgcagagccacattccagtgcaaagaggacagcacatgcatctcactgcccaaggtctgtgatgggcagcctgattgtctcaacggcagcgacgaagagcagtgccaggaaggggtgccatgtgggacattcaccttccagtgtgaggaccggagctgcgtgaagaagcccaacccgcagtgtgatgggcggcccgactgcagggacggctcggatgaggagcactgtgactgtggcctccagggcccctccagccgcattgttggtggagctgtgtcctccgagggtgagtggccatggcaggccagcctccaggttcggggtcgacacatctgtgggggggccctcatcgctgaccgctgggtgataacagctgcccactgcttccaggaggacagcatggcctccacggtgctgtggaccgtgttcctgggcaaggtgtggcagaactcgcgctggcctggagaggtgtccttcaaggtgagccgcctgctcctgcacccgtaccacgaagaggacagccatgactacgacgtggcgctgctgcagctcgaccacccggtggtgcgctcggccgccgtgcgccccgtctgcctgcccgcgcgctcccacttcttcgagcccggcctgcactgctggattacgggctggggcgccttgcgcgagggcggccccatcagcaacgctctgcagaaagtggatgtgcagttgatcccacaggacctgtgcagcgaggtctatcgctaccaggtgacgccacgcatgctgtgtgccggctaccgcaagggcaagaaggatgcctgtcagggtgactcaggtggtccgctggtgtgcaaggcactcagtggccgctggttcctggcggggctggtcagctggggcctgggctgtggccggcctaactacttcggcgtctacacccgcatcacaggtgtgatcagctggatccagcaagtggtgacctgaggaactgcccccctgcaaagcagggcccacctcctggactcagagagcccagggcaactgccaagcagggggacaagtattctggcggggggtgggggagagagcaggccctgtggtggcaggaggtggcatcttgtctcgtccctgatgtctgctccagtgatggcaggaggatggagaagtgccagcagctgggggtcaagacgtcccctgaggacccaggcccacacccagcccttctgcctcccaattctctctcctccgtccccttcctccactgctgcctaatgcaaggcagtggctcagcagcaagaatgctggttctacatcccgaggagtgtctgaggtgcgccccactctgtacagaggctgtttgggcagccttgcctccagagagcagattccagcttcggaagcccctggtctaacttgggatctgggaatggaaggtgctcccatcggaggggaccctcagagccctggagactgccaggtgggcctgctgccactgtaagccaaaaggtggggaagtcctgactccagggtccttgccccacccctgcctgccacctgggccctcacagcccagaccctcactgggaggtgagctcagctgccctttggaataaagctgcctgatc

SEQ ID NO: 32336 - DNA, 3260 bp, Homo sapiens
cttgagccagacccagtccagctctggtgcctgccctctggtgcgagctgacctgagatgcacttccctcctctgtgagctgtctcggcacccacttgcagtcactgccgcctgatgttgttactcttccactccaaaaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttggggagggacccctcacctgcttcttctggttcattctccaaatccccgagcaccgccggctgatgctgagccccgaggtggtgcaggcactgctggtggaggagctgctgtccacagtcaacagctcggctgccgtcccctacagggccgagtacgaagtggaccccgagggcctagtgatcctggaagccagtgtgaaagacatagctgcattgaattccacgctgggttgttaccgctacagctacgtgggccagggccaggtcctccggctgaaggggcctgaccacctggcctccagctgcctgtggcacctgcagggccccaaggacctcatgctcaaactccggctggagtggacgctggcagagtgccgggaccgactggccatgtatgacgtggccgggcccctggagaagaggctcatcacctcggtgtacggctgcagccgccaggagcccgtggtggaggttctggcgtcgggggccatcatggcggtcgtctggaagaagggcctgcacagctactacgaccccttcgtgctctccgtgcagccggtggtcttccaggcctgtgaagtgaacctgacgctggacaacaggctcgactcccagggcgtcctcagcaccccgtacttccccagctactactcgccccaaacccactgctcctggcacctcacggtgccctctctggactacggcttggccctctggtttgatgcctatgcactgaggaggcagaagtatgatttgccgtgcacccagggccagtggacgatccagaacaggaggctgtgtggcttgcgcatcctgcagccctacgccgagaggatccccgtggtggccacggccgggatcaccatcaacttcacctcccagatctccctcaccgggcccggtgtgcgggtgcactatggcttgtacaaccagtcggacccctgccctggagagttcctctgttctgtgaatggactctgtgtccctgcctgtgatggggtcaaggactgccccaacggcctggatgagagaaactgcgtttgcagagccacattccagtgcaaagaggacagcacatgcatctcactgcccaaggtctgtgatgggcagcctgattgtctcaacggcagcgacgaagagcagtgccaggaaggggtgccatgtgggacattcaccttccagtgtgaggaccggagctgcgtgaagaagcccaacccgcagtgtgatgggcggcccgactgcagggacggctcggatgaggagcactgtgactgtggcctccagggcccctccagccgcattgttggtggagctgtgtcctccgagggtgagtggccatggcaggccagcctccaggttcggggtcgacacatctgtgggggggccctcatcgctgaccgctgggtgataacagctgcccactgcttccaggaggacagcatggcctccacggtgctgtggaccgtgttcctgggcaaggtgtggcagaactcgcgctggcctggagaggtgtccttcaaggtgagccgcctgctcctgcacccgtaccacgaagaggacagccatgactacgacgtggcgctgctgcagctcgaccacccggtggtgcgctcggccgccgtgcgccccgtctgcctgcccgcgcgctcccacttcttcgagcccggcctgcactgctggattacgggctggggcgccttgcgcgagggcgccctacgggcggatgctgtggccctattttatggatggagaaaccaaggctcagagacatgttgctgccccatcagcaacgctctgcagaaagtggatgtgcagttgatcccacaggacctgtgcagcgaggtctatcgctaccaggtgacgccacgcatgctgtgtgccggctaccgcaagggcaagaaggatgcctgtcagggtgactcaggtggtccgctggtgtgcaaggcactcagtggccgctggttcctggcggggctggtcagctggggcctgggctgtggccggcctaactacttcggcgtctacacccgcatcacaggtgtgatcagctggatccagcaagtggtgacctgaggaactgcccccctgcaaagcagggcccacctcctggactcagagagcccagggcaactgccaagcagggggacaagtattctggcggggggtgggggagagagcaggccctgtggtggcaggaggtggcatcttgtctcgtccctgatgtctgctccagtgatggcaggaggatggagaagtgccagcagctgggggtcaagacgtcccctgaggacccaggcccacacccagcccttctgcctcccaattctctctcctccgtccccttcctccactgctgcctaatgcaaggcagtggctcagcagcaagaatgctggttctacatcccgaggagtgtctgaggtgcgccccactctgtacagaggctgtttgggcagccttgcctccagagagcagattccagcttcggaagcccctggtctaacttgggatctgggaatggaaggtgctcccatcggaggggaccctcagagccctggagactgccaggtgggcctgctgccactgtaagccaaaaggtggggaagtcctgactccagggtccttgccccacccctgcctgccacctgggccctcacagcccagaccctcactgggaggtgagctcagctgccctttggaataaagctgcctgatccaa

SEQ ID NO: 32337 - DNA, 3122 bp, Homo sapiens
gagccacctaccctgctccgaggccaggcctgcagggcctcatcggccagagggtgatcagtgagcagaaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttggggagggacccctcacctgcttcttctggttcattctccaaatccccgagcaccgccggctgatgctgagccccgaggtggtgcaggcactgctggtggaggagctgctgtccacagtcaacagctcggctgccgtcccctacagggccgagtacgaagtggaccccgagggcctagtgatcctggaagccagtgtgaaagacatagctgcattgaattccacgctgggttgttaccgctacagctacgtgggccagggccaggtcctccggctgaaggggcctgaccacctggcctccagctgcctgtggcacctgcagggccccaaggacctcatgctcaaactccggctggagtggacgctggcagagtgccgggaccgactggccatgtatgacgtggccgggcccctggagaagaggctcatcacctcggtgtacggctgcagccgccaggagcccgtggtggaggttctggcgtcgggggccatcatggcggtcgtctggaagaagggcctgcacagctactacgaccccttcgtgctctccgtgcagccggtggtcttccaggcctgtgaagtgaacctgacgctggacaacaggctcgactcccagggcgtcctcagcaccccgtacttccccagctactactcgccccaaacccactgctcctggcacctcacggtgccctctctggactacggcttggccctctggtttgatgcctatgcactgaggaggcagaagtatgatttgccgtgcacccagggccagtggacgatccagaacaggaggctgtgtggcttgcgcatcctgcagccctacgccgagaggatccccgtggtggccacggccgggatcaccatcaacttcacctcccagatctccctcaccgggcccggtgtgcgggtgcactatggcttgtacaaccagtcggacccctgccctggagagttcctctgttctgtgaatggactctgtgtccctgcctgtgatggggtcaaggactgccccaacggcctggatgagagaaactgcgtttgcagagccacattccagtgcaaagaggacagcacatgcatctcactgcccaaggtctgtgatgggcagcctgattgtctcaacggcagcgacgaagagcagtgccaggaaggggtgccatgtgggacattcaccttccagtgtgaggaccggagctgcgtgaagaagcccaacccgcagtgtgatgggcggcccgactgcagggacggctcggatgaggagcactgtgactgtggcctccagggcccctccagccgcattgttggtggagctgtgtcctccgagggtgagtggccatggcaggccagcctccaggttcggggtcgacacatctgtgggggggccctcatcgctgaccgctgggtgataacagctgcccactgcttccaggaggacagcatggcctccacggtgctgtggaccgtgttcctgggcaaggtgtggcagaactcgcgctggcctggagaggtgtccttcaaggtgagccgcctgctcctgcacccgtaccacgaagaggacagccatgactacgacgtggcgctgctgcagctcgaccacccggtggtgcgctcggccgccgtgcgccccgtctgcctgcccgcgcgctcccacttcttcgagcccggcctgcactgctggattacgggctggggcgccttgcgcgagggcggccccatcagcaacgctctgcagaaagtggatgtgcagttgatcccacaggacctgtgcagcgaggtctatcgctaccaggtgacgccacgcatgctgtgtgccggctaccgcaagggcaagaaggatgcctgtcagggtgactcaggtggtccgctggtgtgcaaggcactcagtggccgctggttcctggcggggctggtcagctggggcctgggctgtggccggcctaactacttcggcgtctacacccgcatcacaggtgtgatcagctggatccagcaagtggtgacctgaggaactgcccccctgcaaagcagggcccacctcctggactcagagagcccagggcaactgccaagcagggggacaagtattctggcggggggtgggggagagagcaggccctgtggtggcaggaggtggcatcttgtctcgtccctgatgtctgctccagtgatggcaggaggatggagaagtgccagcagctgggggtcaagacgtcccctgaggacccaggcccacacccagcccttctgcctcccaattctctctcctccgtccccttcctccactgctgcctaatgcaaggcagtggctcagcagcaagaatgctggttctacatcccgaggagtgtctgaggtgcgccccactctgtacagaggctgtttgggcagccttgcctccagagagcagattccagcttcggaagcccctggtctaacttgggatctgggaatggaaggtgctcccatcggaggggaccctcagagccctggagactgccaggtgggcctgctgccactgtaagccaaaaggtggggaagtcctgactccagggtccttgccccacccctgcctgccacctgggccctcacagcccagaccctcactgggaggtgagctcagctgccctttggaataaagctgcctgatc

SEQ ID NO: 32338 - DNA, 3178 bp, Homo sapiens
ggacaaacagaggctcctgaggcctgtgtgcaggcccggcacctatctgccgctcccaaaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttggggagggacccctcacctgcttcttctggttcattctccaaatccccgagcaccgccggctgatgctgagccccgaggtggtgcaggcactgctggtggaggagctgctgtccacagtcaacagctcggctgccgtcccctacagggccgagtacgaagtggaccccgagggcctagtgatcctggaagccagtgtgaaagacatagctgcattgaattccacgctgggttgttaccgctacagctacgtgggccagggccaggtcctccggctgaaggggcctgaccacctggcctccagctgcctgtggcacctgcagggccccaaggacctcatgctcaaactccggctggagtggacgctggcagagtgccgggaccgactggccatgtatgacgtggccgggcccctggagaagaggctcatcacctcggtgtacggctgcagccgccaggagcccgtggtggaggttctggcgtcgggggccatcatggcggtcgtctggaagaagggcctgcacagctactacgaccccttcgtgctctccgtgcagccggtggtcttccaggcctgtgaagtgaacctgacgctggacaacaggctcgactcccagggcgtcctcagcaccccgtacttccccagctactactcgccccaaacccactgctcctggcacctcacggtgccctctctggactacggcttggccctctggtttgatgcctatgcactgaggaggcagaagtatgatttgccgtgcacccagggccagtggacgatccagaacaggaggctgtgtggcttgcgcatcctgcagccctacgccgagaggatccccgtggtggccacggccgggatcaccatcaacttcacctcccagatctccctcaccgggcccggtgtgcgggtgcactatggcttgtacaaccagtcggacccctgccctggagagttcctctgttctgtgaatggactctgtgtccctgcctgtgatggggtcaaggactgccccaacggcctggatgagagaaactgcgtttgcagagccacattccagtgcaaagaggacagcacatgcatctcactgcccaaggtctgtgatgggcagcctgattgtctcaacggcagcgacgaagagcagtgccaggaaggggtgccatgtgggacattcaccttccagtgtgaggaccggagctgcgtgaagaagcccaacccgcagtgtgatgggcggcccgactgcagggacggctcggatgaggagcactgtgactgtggcctccagggcccctccagccgcattgttggtggagctgtgtcctccgagggtgagtggccatggcaggccagcctccaggttcggggtcgacacatctgtgggggggccctcatcgctgaccgctgggtgataacagctgcccactgcttccaggaggacagcatggcctccacggtgctgtggaccgtgttcctgggcaaggtgtggcagaactcgcgctggcctggagaggtgtccttcaaggtgagccgcctgctcctgcacccgtaccacgaagaggacagccatgactacgacgtggcgctgctgcagctcgaccacccggtggtgcgctcggccgccgtgcgccccgtctgcctgcccgcgcgctcccacttcttcgagcccggcctgcactgctggattacgggctggggcgccttgcgcgagggcgccctacgggcggatgctgtggccctattttatggatggagaaaccaaggctcagagacatgttgctgccccatcagcaacgctctgcagaaagtggatgtgcagttgatcccacaggacctgtgcagcgaggtctatcgctaccaggtgacgccacgcatgctgtgtgccggctaccgcaagggcaagaaggatgcctgtcagggtgactcaggtggtccgctggtgtgcaaggcactcagtggccgctggttcctggcggggctggtcagctggggcctgggctgtggccggcctaactacttcggcgtctacacccgcatcacaggtgtgatcagctggatccagcaagtggtgacctgaggaactgcccccctgcaaagcagggcccacctcctggactcagagagcccagggcaactgccaagcagggggacaagtattctggcggggggtgggggagagagcaggccctgtggtggcaggaggtggcatcttgtctcgtccctgatgtctgctccagtgatggcaggaggatggagaagtgccagcagctgggggtcaagacgtcccctgaggacccaggcccacacccagcccttctgcctcccaattctctctcctccgtccccttcctccactgctgcctaatgcaaggcagtggctcagcagcaagaatgctggttctacatcccgaggagtgtctgaggtgcgccccactctgtacagaggctgtttgggcagccttgcctccagagagcagattccagcttcggaagcccctggtctaacttgggatctgggaatggaaggtgctcccatcggaggggaccctcagagccctggagactgccaggtgggcctgctgccactgtaagccaaaaggtggggaagtcctgactccagggtccttgccccacccctgcctgccacctgggccctcacagcccagaccctcactgggaggtgagctcagctgccctttggaataaagctgcctgatc

SEQ ID NO: 32339 - DNA, 526 bp, Homo sapiens
aaaaggcagggaagtcctgcttccgtgccccaccggtgctcagcagaggctcccttgcaaatgcgaggctgtttccaactttggtctgtttccctggcaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttggggagggacccctcacctgctt

SEQ ID NO: 32340 - DNA, 1695 bp, Homo sapiens
gttcttgagccagacccagtccagctctggtgcctgccctctggtgcgagctgacctgagatgcacttccctcctctgtgagctgtctcggcacccacttgcagtcactgccgcctgatgttgttactcttccactccaaaaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttggggagggacccctcacctgcttcttctggttcattctccaaatccccgagcaccgccggctgatgctgagccccgaggtggtgcaggcactgctggtggaggagctgctgtccacagtcaacagctcggctgccgtcccctacagggccgagtacgaagtggaccccgagggcctagtgatcctggaagccagtgtgaaagacatagctgcattgaattccacgctgggttgttaccgctacagctacgtgggccagggccaggtcctccggctgaaggggcctgaccacctggcctccagctgcctgtggcacctgcagggccccaaggacctcatgctcaaactccggctggagtggacgctggcagagtgccgggaccgactggccatgtatgacgtggccgggcccctggagaagaggctcatcacctcggtgtacggctgcagccgccaggagcccgtggtggaggttctggcgtcgggggccatcatggcggtcgtctggaagaagggcctgcacagctactacgaccccttcgtgctctccgtgcagccggtggtcttccaggcctgtgaagtgaacctgacgctggacaacaggctcgactcccagggcgtcctcagcaccccgtacttccccagctactactcgccccaaacccactgctcctggcacctcacggtgccctctctggactacggcttggccctctggtttgatgcctatgcactgaggaggcagaagtatgatttgccgtgcacccagggccagtggacgatccagaacaggaggtaccacttcctctcctccctctggcttcctttcctccctccccctccctctcttccctcctcaatagtgaccccctcattggaagcccaagtccccaatctcagaggggcagcaaggggagcgagcagaggctggggctggtgtcaggcctgttgcccttgaccttgtcctcgtcccagcctccgccctggccccggcttcccctctggctaccccagaggtctcagacacgtttggtcatcagacaccttggatgtttattctaattacagcaaaattgtctcatcttcttgggtgctgtaaccccctctggcaccctcaatccttcaataaaatgtttccagagccaaagga

SEQ ID NO: 32341 - DNA, 1973 bp, Homo sapiens
gtgggcatcaggaagaagtaacctgttgaatctatttctgctccccacccttactgcttcccataagggggaagccgcagactaataagcctcttccaaaaaagaggtaaagggaggtagacaaggggcggcagcggaggctggctactgcattccgtaggaggagccaacagttactttttacctgctgagtccggtgaaccagttcatgggggcggggacctgcctatgagaaaagggccaggatagaagagcccaaagcgatagaaccgcatggcttccgcagtctgggggagtgccccctggtggggcccgccgcccccggccccagctcggccgctcacggacatcgacttctgctccggggcgcagctgcaggaattgacccagctgatccaggagctgggtgtgcaggagagctggagtgacgggcccaagccgggagccgatctcctccgggccaaggactttgtcttctctttgcttggtctagttcaccgccgggaccctcgctttcctccccaggcagagctcttgctgcttcgtggtgggattcgcgagggctccctggatctggggcatgcacccctgggtccctacgcccggggacctcactacgatgccggcttcacactcctagtgcccatgttttcactggacggcactgaactgcaactggacctggaatcctgttacgcacaggtctgcctcccagagatggtgtgcggaacccccatccgggagatgtggcaggattgcttaggacccccagtcccaggagcacgtgattcgatccaccgaacggagagcgaagaaagttccaaggactggcaaagctctgtagaccagccgcacagctacgtcactgagcacgaggcgccggtgtctttggaaaaatcgcctagtgacgtttcagcgtccgagtcgcctcagcatgacgtcgtcgaccttggctctaccgcacctttgaaaacaatgagtagtgacgtcaccaaggcagccgtcgaaagcccagtcccaaagccgtcggaggctcgggaagcgtggcccacattatgttccgcccaggtggctgcctggttctttgctacgctggcggcggtcgccgagtctctgatccctgtcccgggtgctccgcgtctggtgcacgcagctcgccacgcgggtttcaccaccgtcctcctggctacccctgagccccctcgccgcctcctgctcttcgacctgatcccagtggtgtccgtggcgggctggcccgagggggctcggagccactcgtgggccggtccgctggcctctgagtcggcttccttctacctggtgcccggtggcggcaccgagcggccgtgcgcctccgcctggcagctctgttttgcccgccaggagctggcgctcaaagcgcgcataccagcgccgctgctgcaggcgcacgcggcggcccaggcgctactgcgcccgctggtggccgggacccgggcggcggcgccctacctcctgcggacgctgctgtactgggcgtgcgagcggctgcctgcgctctacctggcgcggccagaaaatgcgggcgcctgctgcctcgggctgctagacgagctcggccgagtgctcgaggccgggacgttgcctcactattttctgaacggccgacagctccgtacgggggacgactccgctgcgctgctcggagaattggcccggctccgcggggacccggcccgggccctccgtgccgcggtggaggaggccaaagtggcccgcaaggggggcggtttggcgggcgtggggggcggggcccattaaagacgctgttcctaccagtggaaagtgcctctgtgggcgagcgggacgtggggggccctgctcgcccctcgccagggggactgactgtgtgccctgggcctgaagccccccttctggaagacctccctgttggttcctcctctacgcccacccgcctgcccccgcacaagttg

SEQ ID NO: 32342 - DNA, 1962 bp, Homo sapiens
gaagaagtaacctgttgaatctatttctgctccccacccttactgcttcccataagggggaagccgcagactaataagcctcttccaaaaaagaggtaaagggaggtagacaaggggcggcagcggaggctggctactgcattccgtaggaggagccaacagttactttttacctgctgagtccggtgaaccagttcatgggggcggggacctgcctatgagaaaagggccaggatagaagaggtatttatttgttcattttgaggactaaatttagaacccatcatctacagacccatttgtaggttgtgtctggggcactcgctcggcctcaggaagagggaagaacggggacgactttgtggcagcaaagccacctcccttccgtgttttccgcagcccaaagcgatagaaccgcatggcttccgcagtctgggggagtgccccctggtggggcccgccgcccccggccccagctcggccgctcacggacatcgacttctgctccggggcgcagctgcaggaattgacccagctgatccaggagctgggtgtgcaggagagctggagtgacgggcccaagccgggagccgatctcctccgggccaaggactttgtcttctctttgcttggtctagttcaccgccgggaccctcgctttcctccccaggcagagctcttgctgcttcgtggtgggattcgcgagggctccctggatctggggcatgcacccctgggtccctacgcccggggacctcactacgatgccggcttcacactcctagtgcccatgttttcactggacggcactgaactgcaactggacctggaatcctgttacgcacaggtctgcctcccagagatggtgtgcggaacccccatccgggagatgtggcaggattgcttaggacccccagtcccaggagcacgtgattcgatccaccgaacggagagcgaagaaagttccaaggactggcaaagctctgtagaccagccgcacagctacgtcactgagcacgaggcgccggtgtctttggaaaaatcgcctagtgacgtttcagcgtccgagtcgcctcagcatgacgtcgtcgaccttggctctaccgcacctttgaaaacaatgagtagtgacgtcaccaaggcagccgtcgaaagcccagtcccaaagccgtcggaggctcgggaagcgtggcccacattatgttccgcccaggtggctgcctggttctttgctacgctggcggcggtcgccgagtctctgatccctgtcccgggtgctccgcgtctggtgcacgcagctcgccacgcgggtttcaccaccgtcctcctggctacccctgagccccctcgccgcctcctgctcttcgacctgatcccagtggtgtccgtggcgggctggcccgagggggctcggagccactcgtgggccggtccgctggcctctgagtcggcttccttctacctggtgcccggtggcggcaccgagcggccgtgcgcctccgcctggcagctctgttttgcccgccaggagctggcgctcaaagcgcgcataccagcgccgctgctgcaggcgcacgcggcggcccaggcgctactgcgcccgctggtggccgggacccgggcggcggcgccctacctcctgcggacgctgctgtactgggcgtgcgagcggctgcctgcgctctacctggcgcggccagaaaatgcgggcgcctgctgcctcgggctgctagacgagctcggccgagtgctcgaggccgggacgttgcctcactattttctgaacggccgacagctccgtacgggggacgactccgctgcgctgctcggagaattggcccggctccgcggggacccggcccgggccctccgtgccgcggtggaggaggccaaagtggcccgcaaggggggcggtttggcgggcgtggggggcggggcccattaaagacgctgttcctacca

SEQ ID NO: 32343 - DNA, 6432 bp, Homo sapiens
acggcggccgcgcgctccaggccggtcgctccaccccccggctcccgggactgtggactccacgaccctgtcctcggccctgtccgcgccgaagcagcccgggactgcgcagcgccccgcgtgccgatcttttcctaattcagcagcgatttaaccaagagcctggaatattttaaggagtaataagagacatttacaaactattctctctgaagcctgctacctggaggcatcatctagataatcagaaccttggcttccacatcctcctcccttgtcttaactacaaacatttctttctgctgacttcaactcctcagacatgggaaagtctctttctcatttgcctttgcattcaagcaaagaagatgcttatgatggagtcacatctgaaaacatgaggaatggactggttaatagtgaagtccataatgaagatggaagaaatggagatgtctctcagtttccatatgtggaatttacaggaagagatagtgtcacctgccctacttgtcagggaacaggaagaattcctagggggcaagaaaaccaactggtggcattgattccatatagtgatcagagattaaggccaagaagaacaaagctgtatgtgatggcttctgtgtttgtctgtctactcctttctggattggctgtgtttttccttttccctcgctctatcgacgtgaaatacattggtgtaaaatcagcctatgtcagttatgatgttcagaagcgtacaatttatttaaatatcacaaacacactaaatataacaaacaataactattactctgtcgaagttgaaaacatcactgcccaagttcaattttcaaaaacagttattggaaaggcacgcttaaacaacataaccattattggtccacttgatatgaaacaaattgattacacagtacctaccgttatagcagaggaaatgagttatatgtatgatttctgtactctgatatccatcaaagtgcataacatagtactcatgatgcaagttactgtgacaacaacatactttggccactctgaacagatatcccaggagaggtatcagtatgtcgactgtggaagaaacacaacttatcagttggggcagtctgaatatttaaatgtacttcagccacaacagtaaaaactggaagagatggatttaaagaagaaatatctattgatatttcctatactctcaatgaagaggtatttcctaataggagaccttaaattgaacaaacctaaagtttacacttctaagagtacagttaaaagtatgtggacctgcagttcttgtaactctccactctgtgttaatgatatatttgtactaggatcttttacttgaatctaaatttactggttgatttccttctccagcctatcccctacagggaaaagctgatacttcccctatagtacaataaataattatttaaaagtcatagctccagtcactactgaaaacataattttggtgataaacataatttgagaaacttaatttctgaatgtttttatagaaaattactgaaagtctattactcatggaagacttttaaagaataaccttttttcctgttttataaattcccattgttatatggtagtatttcagctacacaatattttagcttttagctagacatttatagcttttcatttgttgaaatggtaatcatctgcatgtttttgtcacttatttcaggttagtgattgcctaacacttataagccaaaataatctttgcaaaattccatacctaaaattttgaaagcccctaatgttttcacacatctttctgtattagttatagttttgtgaaatctttgtgtgatcttcaaacattatcatttaatgtacaatactgtaaataaactgtgcatggcttttatacagctttagtaaatgtcaaataaagtggtacagactcattacaacaagtttctcataaaaatacaataaataggaaaatgaaattcagaaacccatagactgggaataggttccagttacagcttggatctggcataaaataaatttgaaataaaatattttgatgctccatttttttatgttgcttttcatactaaagaatggtgtagacatgttttgcaactgttaggtacccagttatcaattttatcaatgttttagaggaggaaattatttttttggtagaaattgttcaagaaatccttaattgaatgtcattaaatgatggtggccaaaataaaacctatttagaaatttaatcactttgcacatcacttggaatatgatgcctctagtagttacttttttatagttttctacttttggttttatttaaaattgttttcaaatatagattattgacttattcaactttgctgttttatattttcagtatcatttttcatttttttttttttttgtcttttcacttaccaagttctagggacatttaaaatatgtactaagtgtaggagtggttatgataccaaaaaatgtagctgggttgagattaatttcgttctgttttctcatgacagaaatcaggtttccctttccccacccctaagtgcctaacttaggtctgaaacagcctgtttattagtctgactctctcaaccataaaacataagctttatttaattctgcctttaaacacactcaggtttccccttaattttcatattattttctgcaagttttcttgagtatcttcaattcgttgaatgtggtttttggtttttttttgttttaacactagtcttcccttaattcattgctaactcaagccatccttactattaaacccaaatcagtcctttaagttcattatggcctttctagtatttaaaaaaaaaaaaatcattttcatttttcttctgctacgtttcctgactactactgcatacttctctgatacaggttctgtttgtattttttatatcattctcattttctcatttgacatgatctatgtctatatatgatataggtccccttttgtctcaaaatttttaattatgtgacttcaaaaatcacctgtatctgtagtagggcttccaaatctgcttctccatatgtgaccagtcacctgtctgctttcacatttagctagtgaactacacatttactaaaatgtgtaaattttacacatttagtgactgtgtaaaataaaaaaaaagttattttatcatatcctttctattatgttcccatcctgtcctcatgtcccatttactttattatcaccattcatttcttcaaaattatcttttagatacgctcatacaaaaatcaatccttgttttcttgcttgtgtcttttaaccttggaaaattacatcgtgtaaattaaacagatttttctgatgatctgtgcttcttatatactattagagtgcatgatagtatctcctgaaaaggatggaaagtagaagcatttgcttttagtcacttaattttgaatcttttttcttcatcttttgaattaattttttttattatatctacttttagtggagtttgagtcagaaaaaaacaagaatttgaaacaagtaaaaagatagaagagaaataaagatggtatgtgactactttcagagagagttaagtaactgtcagaataagcctggaacaaaacaggctgtaaattaataaaactacaaacacacattcaggtgaagcagaagtatagccataaaacatctagaaagagtgaatgaggcttttagcttttcttaggtcaatgtccagtgtgcttttttccatgggaataggataggtattaatacgcttttctaaactgctctcagaccttatccagaggacatggtaaagatatgttacagaaatttttctgatacttcctggaataactttaagttacaccctagtagactggtcattctaataaaatccagtactataacaaacctctgtatgttgatagcacattggccctttttagagttctttcctatgtttttcttacgtgatttcccacagttccatgagtccaacaaaggagagtgataggctccttatcttttagaagaggaaggaaaggcatgaagaagttgagggactggctgaagatcacgtacttactaagtagtacaactggagcaagatcaagtatctctgtctcccatatctgtgttctatcatttaaaatatatattggaaatccctgctgactcagattggtatgattaaaaatgagaggaaagttcaaatagttagtagtgacaaactaatactgctggactaagattttggtagcattgttttctaaaatattttaaatggagaatgaacacttataaaatgctttggaacataatctttagcttaattttctgttaaaatttagtaccccttcatcattccaataaagataagactgatccattgtctaaggaaattatttataaataatagagattaatttatttgagatttgaaataagaatagtatgaaaatattagataccacataaattgtttgaaattactgaataaccatcttaagtatggaacatttaaatggctatattttatttgtgtacagtttttctgtgccttgttaggccagtgaagcaattattttctctaagaaaatgacaataaaatataacacacttcagattgtctgatttacagtttggaaaggacaccgcaatgttcaaataggtaggagaccatcaaaaacacaattaaagtaacatattaggagacttgaaacttcagcctaataaatccttcatggttcttagccttattattgtgatataattctagatattttcttggagggcatgtgcccaactctcccgcaccccattttgtttgtcttttaaagttcttagaataaacagttctttatataataattatattttatttaagaaaatagtttgttaggtactttttaaaagatgtaaatttttaaatttacaaatacatatgggtctttgataagcaataggaattgaattacaagttactagggttataagcaaaaggttgcttaccataatgtcattaggtcacgatttttagctcacatctggaagcagcaactacttggctcaagtacatataagagtaattagttttattctctcttttttataaaatcgggtttcagatgagatgtttatcttagactattttagggaaaaattttacatgtttgagatggtggagtaaaaagactgttaaacatttcttttaaaaaattatttttacattacaacaatatatttatgatgtgttcagatcaaaaatttaacttctgtgtcccagatctactttcaaagtgagattttcacttgtcagcttaaatttctgactagaactaacatttgtgtatttttgtgcttagtcggaatacaaatttcacagtggatttttgaagtttgtccttaaattggataaaatcaagtgattaaagttactaaagagataaaaatggtaatttccatttttaaaagtaatttggttgtgtttatagttatttgtacaagtatttatcacagactctaaattgaaaaatgtagtatgatctatatttgaccctaaaaatgttggattaatttaacaaatatggcagatttttcataactaagtcttaagtcttctaaaaggaagctgttacccttctgtttttaattacattaattgaaatgtgttttaagagatacaatttcagcatattttatatattaaaaaacaaaaaaggattagtattgagccagtggccaaaaggtaatattactaccatgtagactgttatagttcaaattgtcccacttcacccagaattttagaaactagaagtctgggaggtactatatcagctgtagttgggtaattccaagtgctgatagtactattcatcttttttattattgtgtcagatgaaacaaatgccaagttgcaaaatatgcagatttttattatataatggttttaggcataaattattaacaagccatgccttatgtgtttcatcttatatttttctttagaactaaactataacagattttggaaaatgatttgacgtgcttgctcacttgattgacttggtcagatatttgaatgatggtattacctagattctaatccttgattctagttatataataaataatatagaatatgaaaatatgtttgggcatttactgtttatattatgtagtagcctccatcatgacacacttactacatttatgaattgagcagttctgtaattgtaattattattgctgttcatgtaacaaaacatgcttataatagcaaacaaatagaaatgcccccaaaatgctatttttttaattcagttataactgttactcttgtagttgtgtatgacgcaataaaatttgtaaaaaaatttcagcatgaaaaataaaatttgtatcactta

SEQ ID NO: 32344 - DNA, 2126 bp, Homo sapiens
agcagcgcttggcctctgctgatgccgtcgttatcctacccctcccccgtcccagctctacggcggccgcgcgctccaggccggtcgctccaccccccggctcccgggactgtggactccacgaccctgtcctcggccctgtccgcgccgaagcagcccgggactgcgcagcgccccgcgtgccgacatgggaaagtctctttctcatttgcctttgcattcaagcaaagaagatgcttatgatggagtcacatctgaaaacatgaggaatggactggttaatagtgaagtccataatgaagatggaagaaatggagatgtctctcagtttccatatgtggaatttacaggaagagatagtgtcacctgccctacttgtcagggaacaggaagaattcctagggggcaagaaaaccaactggtggcattgattccatatagtgatcagagattaaggccaagaagaacaaagctgtatgtgatggcttctgtgtttgtctgtctactcctttctggattggctgtgtttttccttttccctcgctctatcgacgtgaaatacattggtgtaaaatcagcctatgtcagttatgatgttcagaagcgtacaatttatttaaatatcacaaacacactaaatataacaaacaataactattactctgtcgaagttgaaaacatcactgcccaagttcaattttcaaaaacagttattggaaaggcacgcttaaacaacataaccattattggtccacttgatatgaaacaaattgattacacagtacctaccgttatagcagaggaaatgagttatatgtatgatttctgtactctgatatccatcaaagtgcataacatagtactcatgatgcaagttactgtgacaacaacatactttggccactctgaacagatatcccaggagaggtatcagtatgtcgactgtggaagaaacacaacttatcagttggggcagtctgaatatttaaatgtacttcagccacaacagtaaaaactggaagagatggatttaaagaagaaatatctattgatatttcctatactctcaatgaagaggtatttcctaataggagaccttaaattgaacaaacctaaagtttacacttctaagagtacagttaaaagtatgtggacctgcagttcttgtaactctccactctgtgttaatgatatatttgtactaggatcttttacttgaatctaaatttactggttgatttccttctccagcctatcccctacagggaaaagctgatacttcccctatagtacaataaataattatttaaaagtcatagctccagtcactactgaaaacataattttggtgataaacataatttgagaaacttaatttctgaatgtttttatagaaaattactgaaagtctattactcatggaagacttttaaagaataaccttttttcctgttttataaattcccattgttatatggtagtatttcagctacacaatattttagcttttagctagacatttatagcttttcatttgttgaaatggtaatcatctgcatgtttttgtcacttatttcaggttagtgattgcctaacacttataagccaaaataatctttgcaaaattccatacctaaaattttgaaagcccctaatgttttcacacatctttctgtattagttatagttttgtgaaatctttgtgtgatcttcaaacattatcatttaatgtacaatactgtaaataaactgtgcatggcttttatacagctttagtaaatgtcaaataaagtggtacagactcattacaacaagtttctcataaaaatacaataaataggaaaatgaaattcagaaacccatagactgggaataggttccagttacagcttggatctggcataaaataaatttgaaataaaatattttgatgctccatttttttatgttgcttttcatactaaagaatggtgtagacatgttttgcaactgttaggtacccagttatcaattttatcaatgttttagaggaggaaattatttttttggtagaaattgttcaagaaatccttaattgaatgtcattaaatgatggtggccaaaataaaacctatttagaaatttaa

SEQ ID NO: 32345 - DNA, 496 bp, Homo sapiens
ggtcgctccaccccccggctcccgggactgtggactccacgaccctgtcctcggccctgtccgcgccgaagcagcccgggactgcgcagcgccccgcgtgccggtgagcgaccccggacgtgcagtccccaggtccccttccggagcgaggctgagcggctgcgccgcggcttgagccgggcctgacaaggaggggaggccgctggggtgctgggccagccgcagatcttttcctaattcagcagcgatttaaccaagagcctggaatattttaaggagtaataagagacatttacaaactattctctctgaagcctgctacctggaggcatcatctagataatcagaaccttggcttccacatcctcctcccttgtcttaactacaaacatttctttctgctgacttcaactcctcagacatgggaaagtctctttctcatttgcctttgcattcaagcaaagaagatgcttatgatggagtcacatctgaaaac

SEQ ID NO: 32346 - DNA, 584 bp, Homo sapiens
ctctacggcggccgcgcgctccaggccggtcgctccaccccccggctcccgggactgtggactccacgaccctgtcctcggccctgtccgcgccgaagcagcccgggactgcgcagcgccccgcgtgccggtgagcgaccccggacgtgcagtccccaggtccccttccggagcgaggctgagcggctgcgccgcggcttgagccgggcctgacaaggaggggaggccgctggggtgctgggccagccgcagacatgggaaagtctctttctcatttgcctttgcattcaagcaaagaagatgcttatgatggagtcacatctgaaaacatgaggaatggactggttaatagtgaagtccataatgaagatggaagaaatggagatgtctctcagtttccatatgtggaatttacaggaagagatagtgtcacctgccctacttgtcagggaacaggaagaattcctagggggcaagaaaaccaactggtggcattgattccatatagtgatcagagattaaggccaagaagaacaaagctgtatgtgatggcttctgtgtttgtctgtctactcctttctgga

SEQ ID NO: 32347 - DNA, 516 bp, Homo sapiens
gctcgggaagtgtttgttgattgaatgaaggatgttagtaactgtcctctgcctggtatcctctctgtctcttctaagccatgcatgggacatttgtgattctgctgccgctcagcctgatcctgatggtttttggggggatgacggggtttctgagcttcctcctccaagcctacctcctcctcctgctcactggaattctcttcctctttggagccatggtgaccctcgctgggatcagcgtctacatagcgtattcagccgccgccttccgggaggcgctgtgtctcttggaggagaaggccctcctggaccaggtggacatcagcttcggctggtccctggccctgggctggatcagcttcatcgccgagctgctcaccggggcagccttcctggcagcagcccgcgagctcagcctgagacggaggcaggaccaggccatatgagcctgggcgctgggtcgtggaggggagggaggggcttggccccggagcttcaccgaccgatctccat

SEQ ID NO: 32348 - DNA, 3321 bp, Homo sapiens
cccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatccttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaa

SEQ ID NO: 32349 - DNA, 3579 bp, Homo sapiens
aaaggcttccttccgggcaccgcgaagccagcgtgctcagcattcagggaggcagcggcgctcgccttcatccaggacaacaaaactgccatttccgaagagaaaggaaacggctcgcggtttctggggttcccaagcgcgcgcctgcgagggaggccgcgagccgagtcgccacgcccagaaccccgagcccgcccccgcgccacccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatccttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttct

SEQ ID NO: 32350 - DNA, 739 bp, Homo sapiens
aaagatggctgcgcccaggtaatttgagcaaaggccacagtgaactccggcgtggctgaggaaggaggaggcacccacaggctgctgggaggagagcataaggctcaaaatggaaaatcataaatccaataataaggaaaacataacaattgttgatatatccagaaaaattaaccagcttccagaagcagaaaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacag

SEQ ID NO: 32351 - DNA, 656 bp, Homo sapiens
acgagtcagccaaagatggctgcgcccaggtaatttgagcaaaggccacagtgaactccggcgtggctgaggaaggaggaggcacccacaggctgctgggaggagagcataaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaaca

SEQ ID NO: 32352 - DNA, 1550 bp, Homo sapiens
gctaaccccctaactcccgttcctcctcggcgtttcttctccaagtccgaagtcagggtccaggactgctgcgatgcatcagccccgcctctcatcccccatccagaggaggcggaaatgttcaggtgaacgcgaagcctcccactacgagccggccctcagcaaggccgtgcgcagtgtgggcgggagccctaagtcagctagcggcgacgctgggagggcccggagcaggccgggccccgaacagcgaaagctccaacatggcggccagactggccatagagcgggaagagaaagccggggactagcaggccgcacggcgcagacggggcccgcctcctccatttacttccggaatttaaagccggcttccggaagccgggacgatgtccgcatgacaaccgacgttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatgaacttacgctggaaaaactccaacagcttcatatggacagatggacttcaaatgctgtttgtattccagagactagcagcagtgttgtactgctacttctataaacggacagccgtaagactaggcgatcctcacttctaccaggactctttgtggctgcgcaaggagttcatgcaagttcgaaggtgacctcttgtcacactgatggatacttttccttcctgatagaagccacatttgctgctttgcagggagagttggccctatgcatgggcaaacagctggactttccaaggaaggttcagactagctgtgttcagcattcaagaaggaagatcctccctcttgcacaattagagtgtccccatcggtctccagtgcggcatcccttccttgccttctacctctgttccaccccctttccttcctttcctctctgtaccattcattctccctgaccggcctttcttgccgagggttctgtggctcttacccttgtgaagcttttcctttagcctgggacagaaggacctcccagcccccaaaggatctcccagtgaccaaaggatgcgaagagtgatagttacgtgctcctgactgatcacaccgcagacatttagatttttatacccaaggcactttaaaaaaatgttttataaatagagaataaattgaattcttgttccataaa

SEQ ID NO: 32353 - DNA, 2839 bp, Homo sapiens
aaagccggcttccggaagccgggacgatgtccgcatgacaaccgacgttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatggtaagagtggcagtctgaattctttttttaatttttattttaaatagaggtggggtcttactttgttaccaaggctggtctcaaactcctgagctcaagcaattctcctgcttctgcctcccaagctcaagcaattctcctgcttctgcctcccaaagtgctggaattacaggcatgagtcactgtgcccggcctgaactctgaattcctgaatcgctaaagggctaggaataacttttcttttcttttcttttctttttttttttttttgagacagagtctcgctctgtcgcctggctggagtgcagtggcgtgatctcagctcactgcaacctccgcttcctgggttcaagcaattctcctccctcagtctcctgagtacctgggattacaggcacgcaccaccacgcccagctaatttttgtgtttttagtagagactgggtttcaccatgttggccgggatggtctcaatctcttgacctcgtgatcctcctgcctcggcctctgaagtgctaggattacaggcgtgagctactgcgcccggccactgggatatcttttctctgggaacccagcttcattctttgacatctcacacaatccttcgtagagaacaggtgaaatgaaagtggtttgggttggagccctgggcatgtgagagtttcataaggtactcttgaccaaccttatgtgttgaaaaacagccttgtccaagagtcaggggactcttccagaacattcaattcacctttgccccaaacaggcctaccagggctaaaacaggtagttgaatgtgtctcatcattagctatttgggcaggtggatgttgatacaggttattcttaggcatcagtgccccatggctaatgctgtaggcagtggatgtttttggaagtagccaagcaggattgctgcttgcccttgagtgctccatgccgtctgccaagctcccatcactttaactaggagaaccggcctccaggatccctccctttggttctaacataggcctcagatcagatccagtgtctgtggtttcagatttcttctgcttcacaaattcttccagctctttgagtatcttgtatatttctcatgtactcaattcaattgaactctaaaacctcagggttctctagttgtcacttcattattaaagccactttcacacctgaaccccctgttaggttgtgcttgtgattccacagaaagaagtagaggtcccaggaaagaagcaaagcaacaccagagtctccgggtgcttcctgaagaggattctgtgccctggttcctggagccaaaataggtcctggctttgtactataaaagccgttaatctcattaaaccctgagtacaccaaagtctttatctgacaggagctgagccagcgatttttcaaggcaagacagtgaccagctgaactcctgagataatgaatatatcatttctccttggcaaaggttatggaattaaagagaataaataacttagttcatacttcctccctcaaagttaaaagatattccctttgcagcgaaaaatggagctttgaggctccttcgagaaacgctccttggggttgtagaaaggaggaagaggttagcatgattttaaagcaactggcatctctgcagctaaccaagttggagacattagggcttcttgtggccattaacttttgtgtatctcacatctccttcagaacttacgctggaaaaactccaacagcttcatatggacagatggacttcaaatgctgtttgtattccagagactaggtaaggaccagagcaaggtcaggcctctctcaggtcccacatgtgtctctttcagtgagggccttgatgctggcttcccagacctgtcccagctggcttgggatggttgtgacagccacaccaggaacaggagggattactgcccctgcccttgctagaagactatgggaaatgaggaggcagggctgcccagcctcattaggttctgttctttttgtttgtttgtttgtttgtttgtttgtttttgagacagtcttgctctgtcgcccaggctggagtgctgtggcgctatctcaggctcactgcaagctccgcctcccgggttcacaccattctcctgcctcagcctccggagtagctgggactacaggcgcccgccaccacgcccagctaattttttgtgtatttttagtagagacagggtttcaccgtgttagccaggatggtctcgatctctgacctcatgatccgcctgcctctgcctcctaaagtgctgggattacaggcgtgagccaccacgcctggccaggttctgttcttaacctgaaatgatactca

SEQ ID NO: 32354 - DNA, 1771 bp, Homo sapiens
tataaaaatagctcttgttaccggaaataactgttcatttttcactcctccctcctaggtcacacttttcagaaaaagaatctgcatcctggaaaccagaagaaaaatatgagacggggaatcatcgtgtgatgtgtgtgctgcctttggctgagtgtgtggagtcctgctcaggtgttaggtacagtgtgtttgatcgtggtggcttgaggggaacccgctgttcagagctgtgactgcggctgcactcagagaagctgcccttggctgctcgtagcgccgggccttctctcctcgtcatcatccagagcagccagtgtccgggaggcagaagatgccccactccagcctgcatccatccatcccgtgtcccaggggtcacggggcccagaaggcagccttggttctgctgagtgcctgcctggtgaccctttgggggctaggagagccaccagagcacactctccggtacctggtgctccacctagcctccctgcagctgggactgctgttaaacggggtctgcagcctggctgaggagctgcgccacatccactccaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggcctctcgcaggcactgaacatcctcctgggcctcaagggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggctgtatattctcctcccattggactgtggggtgcctgataacctgagtatggctgaccccaacattcgcttcctggataaactgccccagcagaccggtgaccatgctggcatcaaggatcgggtttacagcaacagcatctatgagcttctggagaacgggcagcgggcgggcacctgtgtcctggagtacgccacccccttgcagactttgtttgccatgtcacaatacagtcaagctggctttagccgggaggataggcttgagcaggccaaactcttctgccggacacttgaggacatcctggcagatgcccctgagtctcagaacaactgccgcctcattgcctaccaggaacctgcagatgacagcagcttctcgctgtcccaggaggttctccggcacctgcggcaggaggaaaaggaagaggttactgtgggcagcttgaagacctcagcggtgcccagtacctccacgatgtcccaagagcctgagctcctcatcagtggaatggaaaagcccctccctctccgcacggatttctcttgagacccagggtcaccaggccagagcctccagtggtctccaagcctctggactgggggctctcttcagtggctgaatgtccagcagagctatttccttccacagggggccttgcagggaagggtccaggacttgacatcttaagatgcgtcttgtccccttgggccagtcatttcccctctctgagcctcggtgtcttcaacctgtgaaatgggatcataatcactgccttacctccctcacggttgttgtgaggactgagtgtgtggaagtttttcataaactttggatgctagtgta

SEQ ID NO: 32355 - DNA, 901 bp, Homo sapiens
ggctagagtgttgtggagaaaccaatcgttgttaacatctcattttcaggctgcactcagagaagctgcccttggctgctcgtagcgccgggccttctctcctcgtcatcatccagagcagccagtgtccgggaggcagaagatgccccactccagcctgcatccatccatcccgtgtcccaggggtcacggggcccagaaggcagccttggttctgctgagtgcctgcctggtgaccctttgggggctaggagagccaccagagcacactctccggtacctggtgctccacctagcctccctgcagctgggactgctgttaaacggggtctgcagcctggctgaggagctgcgccacatccactccaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggcctctcgcaggcactgaacatcctcctgggcctcaagggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggctgtatattctcctcccattggactgtggggtgcctgataacctgagtatggctgaccccaacattcgcttcctggataaactgccccagcagaccggtgaccatgctggcatcaaggatcgggtttacagcaacagcatctatgagcttctggagaacgggcagcgg

SEQ ID NO: 32356 - DNA, 2762 bp, Homo sapiens
ggcagatctcacgagagaggatttggcgccctcctctgtggattctggccaggccgggttcggcggttgctgtgagagcgggcttcccaacaccatgccgtccgccttctctgtcagctctttccccgtcagcatcccagccgtgctcacgcagacggactggactgagccctggctcatggggctggccaccttccacgcgctctgcgtgctcctcacctgcttgtcctcccgaagctacagactacagatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactgggaatttgatttgaagaagtccatgtcatatgtgtaactagtactaattataaatataaaatacacaatataaaatatgaaactcaataataaacagtgccacctgtacatgggcaccatgccctcctcctcgtgctgtgttttctagtgcatgccacagttcgcagtagagggtgttttcaccttccaagacatggggcaaagtttggagacacctggttgtcactggagggggtggtgctcctggcttctcctgtggagcccggggtgatgcataaaatcctgtgtgcctgggtcagccgcatcacagacaatgacttgacatgaaatgtcagctgtgctggggcagagagaccttggaaggaagctcttggaaaatacgttgtatctcagtttgatgaaccaattcacaagaggctaggccctctctagcaaagttatgggctgctttactgaaaacagaatggaagccctgaagtcaacactccatggagaagcgtgtctttcctaatgtcctggtgttctgttgatttaggtgcttgggaacacaatgctcccagttctgttaggacaggcatactgttactttgcaatatccactttataaaatagctcctgcccagtggctcttggttcctgtcaaatgtggacctgtagtttaagaatgacaggtggttagagacccagatatttaaaaataggtgttcaataagggaatactgattgtgcattgtatctggatagcatgcctaattgtgcatttctgaaagttaccaattcaaaatgtaattggaacagttatctttgattagacaagcctgggaagagaatgttgaggtgcagagctcaccagccaagttcatgcccctctcgggcctttgtggctgagaagtgggacagaaagatgattaaggtaatgtgtcctccctgtagcattgtccagggccgttgtgtagatatttgacttcactgacagaaaagaaaccagggagtttgtagagactgtgcatttttagtataacattttcaccatctgatatggtttggctttgtgtccccacccaaattgcatctcaaattgtaatccccatgtgtcaagggagggacctgatgggaggtgatgggatcatgggggtggtttcccctatgttgttatcataatagagagggagttctcacaagatctgctggttttaaagacagcagtttcccctgctgtcactgtctctctcctgctgccttgtgaagaaggtgcttgtttctccctctgccatgattgtaagtttcccgaggcctccccggccatgtggaactgagtcaattaaacttcttgtttataaagtaatccaggtctcaggtagtatctttatagcagtgtgagaacagactaattaaacatctatatgttatttggacttaatatggggccgtgtgattgaatctcagtttgcctgtgataaagtagtgtaacagtattgctagctttgcatgaatttgatgctgatgacatgtcagtgtgaaaccatgacgtgtggtctttgattttcattctgcatgtgtgtgtctgtgttttggaacagttatattttggttttgtaaaaacaaccttcactttatttttaactgtgtagtaagtttatattcaatgccttaaagtgcattgttaacaattgtcttgatatgttgtcctcattttagggaaagtcatagaagccaaaatgatcagcagttgagtaatttacgaaagcacaggtgcaatcccactttaaagcactgggggttgcacagagcacactggtttcaggctccataaatgtggatgactcactggagagcttcatctgtttaagtagaacaaatgtttttactctactgataaagtacaggaaaggaggtttgggatcaaaattatttttcacattccaaacctgtgacaccttacgtttatcgattgctatgcaataaaatacatctttaataata

SEQ ID NO: 32357 - DNA, 775 bp, Homo sapiens
atgctctctggatacttgcagacggactggactgagccctggctcatggggctggccaccttccacgcgctctgcgtgctcctcacctgcttgtcctcccgaagctacagactacagatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactgggaatttgatttgaagaagtccatgtcatatgtgtaactagtactaattataaatataaaatacacaatataaaatatgaaactcaataataaacagtgccacctgtacatgggcaccatgccctcctc

SEQ ID NO: 32358 - DNA, 5288 bp, Homo sapiens
ggcgcggaggcggatgggcgcggctccctcccccactcaggcctcttcacggggcggggggccgggtcccccagcccccacccgcgccgtgtccagctcctcgcgtgctcgcggcggagccctgagcgcactgggtccgagtcctgcgcgccccctcaccacctcccccgcacctgctcctcctcctcggtcccgcccagcgcgccagcagcccgatccccagtgctgggagaagagagggggcgcaggcggcgacacaaagggtggagcggcgggaccgggacccgggaggctgcgcggcatggacgccgagtaccctgcctttgagcccccgctctgcagcgagctcaagcacctgtgccggcggctgcgggaagcgtaccgcgagctcaaggaggacctcacgcccttcaaggatgaccgctactacaggacctaaagtgatccagacttctgcggctaatttttcactaaataatagcaaaaagctaaagccaattcaaatactttcaaatccactgtctacatacaatcagcaactatggctgacatgtgttgttgagttggatcaatcaaaagaaacttctattaagacaagctttcccatgactgttaaagtcgatggtgtagctcaagatggaaccacgatgtacattcataacaaagttcacaaccggacaaggaccctcacatgtgcagggaaatgtgcggagattattgtggctcaccttggctacctgaactacactcagtatacagtgatagtgggatttgaacacctgaagctccccatcaagggaatgaacttcacatggaagacttataaccctgccttctcccggttggaaatctggttccggtttttctttgtggtgctcaccttcatcgtcacttgcctgtttgcgcattccctccggaaattttccatgagagactggggcatcgagcagaagtggatgtctgttctcctgcctctgctgctactttacaatgatccgttcttccccctctccttcctggtcaacagctggctcccagggatgctggatgacctctttcagtccatgttcctgtgcgccctgctgctcttctggctgtgcgtgtaccacgggattcgtgtccagggagaaagaaagtgtttaactttctatttgcctaaattcttcattgttggactattgtggttggcttctgttacgctaggaatatggcaaacagttaacgaattacatgatccaatgtaccagtatcgagttgataccggaaattttcagggaatgaaggtcttcttcatggtggtggcagcggtgtacattctgtacctcttgttcttgatagtgcgggcgtgttccgagctacgtcacatgccttatgtggatctcaggttgaaatttttgactgcattgactttcgtagtacttgtcattagcatcgccatcctttatttgagatttggggcgcaagtactacaagacaattttgtagcagagctgtcaactcactaccagaaaccagccgagttcttatctttctatggcctgttgaacttctatctctacaccttggcctttgtatattctccatcgaagaatgccctctatgagtcccagctgaaagacaatcctgccttctccatgctgaatgactcggatgatgatgtgatttatgggagtgactatgaggaaatgccgctgcagaacggccaggccatccgggccaagtacaaggaggagtcagatagtgactgagccccggccagcccagcgaggcgacaagatgcctggatgctttccccggtgaccgtctgctgaccttcccctgttatattcagatttttcttacaagcagagatttcctgttcatttgtttacatatttttttaaaggaaaaccaaaactgagggtaaatttaaatgtttagccaaatttattgtcatggtggctacgagaagaggcattgataacaagtttcaacagccaaatccttttttacagagatttcagatgagcgtgttttcagtgatgaggaaatttcacgtttttagtacagtgaattatgtacttttttttcctgtaatcattcactgattccaagttcacgggcagcctgtgactaggtcctcagcgtgacagcatcaccctctttcttcccttttccatggtactgttttgtgaccctttaaactcaaagggaagccttatctgtggctgcttcagggcagtccttcctcgttgagtggccagtgccctgggtaaccaggtggctgaagtgattggtcagttatgtggactgcgttttgtgcagtgtgtgagttatgactcatcgggaatgggagatgctggggttccaacccttcacgtcaccaaaggggaagtaatagtgtggagttctgaggagggtttgataagttgaataaggaaaggctaagataatttacaggttaccaactcatgtggggaaggtcttactgccatggtgcttttcaggggcctgtgtgtacacacatgattaaatggatttgcctgtgggaggtatgggcaggagaggaacccttaccattccagtaaatagcagtttctgcaattctgttgaatatgaaatgccatagagctttatttatttatgtaagtaaaagctaaatgaggggccaggtgcagtggctcacatctgtaatctcaacactttgggaggccaaggtgggaggatcacttgagcccaggagtttgagaccagcctgggcaacacagggagaccccgtctctataaaacatttagaaagttggctgggcatgctggggcatgcccatagtcccagctactcaggaggctgaggtgggaggattgcttgagccctggaggtcaaggctgcagtgagccatgattgcaccactgcactccagcctgggtgtcagagcgagaacccgtgtcataaataaataaagctacatgaaagattgatagaatattttagattatttattggccaaaagtttttaaaactcatatttggaagcaaaatgaaaagcaagtaaaatgttttaaatggttcatggaaaacgtatttgggtagaaggcaactcgtgcttccggaaggggttccctgtcctccatgtgtccacatggcggtcaggtagggacgacctgttctgtaaagtccttggcactgctgaatctgtggcatcatagaaggccctggagcttccccgttcctttcagtcagggactccatatagagtctcatgtggacgtctcccgtgctttcctcttgacctctacagtcacacttctgttaacatctggtaactgtgggcaacctgactgatgccgtcttggcaattgaggtccagaagatgatagttccgcaacgcaagcagtacctactttttttcttcatctatgcattgactctcagattaccatgcagagcttcacgttatcatccacgttaagtagtgctaggtaggaccttagagatgttcatgagaaactatttgttatgactttcctttgtatctttccttttaatttaaactttaatgataatgtacttttaatatggattctattcacatttgttttaaaaaccttgtaaatatgaatgtttaagacaacttactgcaagggtaattcaagtttacatgatttttaaatttgcaatgatgttttttttattctgtgtattgaaaaaaattttctgttaccaaattttacaacttctaataagactactataactttatgtaaactgatgaagatgtgctgattaacatattctgtgatatggtttacaacttttaatcataattgtccatgattttggaatgctgttatttatcagtaaatgtaaaatatttgaggcatttagccatacacacactagaactttttaaaactttgtcctatagtgtaattataaactgatgactattatcttcatacattgagtcttcatgcatcaatgaaatgaaaaatataggattatttatttactttttgtaactaagtgggaaataagaaaaaaagttagaaagtacttaaggggaaaatcgttcttactaagtcatgtattttcaacttgtcttccctggtatatcataaataccgacatattacataccccatgtaaaattttgcttaaactctctagcacttggcatgtagaatatgtaccataggtatcaggttaaaacactaaagtctgccagaaacttttgacagtagcaagaaaattgttgaagaaaaaataaattatttactgagggtagttatgttaaagttttgcgaacttaaagggctgactttagttccttcatggtaatggcttgagtaacatcatctttgggattttttaaatactggtccagtctaggagaacctggaagatgaccagaggtatttcagtttccctagggagagcttcgttatccatgtggatgataagtctgcttgatttattattaaatcattatagcagtgaagtggtgccattttctctctcttaagccccatttgaaaggctagagaaggggatatatatactatgttcaaggtttgtaaggttgttaatgtacataattgcagattgcaataaaagcttagatacattttgtaaacccaacccactaaatgagcaggttacaagacaaatgtcaccagcctcaagtattttatgaactatttactgagggtagttatgttaaatagattataatgtggtaaattatttcctgaatcctttatcacaggaaaaacacagaccctcataaaagggataattaaaacggatgtgtctgaacatttagtgaagatgagacttaaaacatgaaagtgtatttgtgtattttgagggttttagaaaccggttgccttagaggttagacttttgaagaaaaaaaaaaaaagatacagatcttttcccctggccaaagggaagttgtattagtctgtgacatcttgtgatgctgtttatcttggtttgacattggagatacgctagtaactgtgataccatactataaaacagaagaattttctgctactaaaaactgcctttttacaaaatgactgtaaatatttgtaaaataaaataacactaaactttaagcccaaaaggagagatagagccatgtgttcagttgtggacctgtccgtggggcacagtgccaccccatcacagtgttgctgtcatcaggcaaaagtgaatgtttgtttatggcaaattcgtcttttgcgaatggcttaattctgacactacctttctgggaaatgttaataaatttttaatattc

SEQ ID NO: 32359 - DNA, 5390 bp, Homo sapiens
cgcggaggcggatgggcgcggctccctcccccactcaggcctcttcacggggcggggggccgggtcccccagcccccacccgcgccgtgtccagctcctcgcgtgctcgcggcggagccctgagcgcactgggtccgagtcctgcgcgccccctcaccacctcccccgcacctgctcctcctcctcggtcccgcccagcgcgccagcagcccgatccccagtgctgggagaagagagggggcgcaggcggcgacacaaagggtggagcggcgggaccgggacccgggaggctgcgcggcatggacgccgagtaccctgcctttgagcccccgctctgcagcgagctcaagcacctgtgccggcggctgcgggaagcgtaccgcgagctcaaggaggacctcacgcccttcaaggatgaccgctactacaggctggcgcccatgcggctctacacgctctccaagcgccactttgtcctcgtgtttgtcgtcttcttcatctgctttggcctgaccatcttcgttgggatcagaggacctaaagtgatccagacttctgcggctaatttttcactaaataatagcaaaaagctaaagccaattcaaatactttcaaatccactgtctacatacaatcagcaactatggctgacatgtgttgttgagttggatcaatcaaaagaaacttctattaagacaagctttcccatgactgttaaagtcgatggtgtagctcaagatggaaccacgatgtacattcataacaaagttcacaaccggacaaggaccctcacatgtgcagggaaatgtgcggagattattgtggctcaccttggctacctgaactacactcagtatacagtgatagtgggatttgaacacctgaagctccccatcaagggaatgaacttcacatggaagacttataaccctgccttctcccggttggaaatctggttccggtttttctttgtggtgctcaccttcatcgtcacttgcctgtttgcgcattccctccggaaattttccatgagagactggggcatcgagcagaagtggatgtctgttctcctgcctctgctgctactttacaatgatccgttcttccccctctccttcctggtcaacagctggctcccagggatgctggatgacctctttcagtccatgttcctgtgcgccctgctgctcttctggctgtgcgtgtaccacgggattcgtgtccagggagaaagaaagtgtttaactttctatttgcctaaattcttcattgttggactattgtggttggcttctgttacgctaggaatatggcaaacagttaacgaattacatgatccaatgtaccagtatcgagttgataccggaaattttcagggaatgaaggtcttcttcatggtggtggcagcggtgtacattctgtacctcttgttcttgatagtgcgggcgtgttccgagctacgtcacatgccttatgtggatctcaggttgaaatttttgactgcattgactttcgtagtacttgtcattagcatcgccatcctttatttgagatttggggcgcaagtactacaagacaattttgtagcagagctgtcaactcactaccagaattcagccgagttcttatctttctatggcctgttgaacttctatctctacaccttggcctttgtatattctccatcgaagaatgccctctatgagtcccagctgaaagacaatcctgccttctccatgctgaatgactcggatgatgatgtgatttatgggagtgactatgaggaaatgccgctgcagaacggccaggccatccgggccaagtacaaggaggagtcagatagtgactgagccccggccagcccagcgaggcgacaagatgcctggatgctttccccggtgaccgtctgctgaccttcccctgttatattcagatttttcttacaagcagagatttcctgttcatttgtttacatatttttttaaaggaaaaccaaaactgagggtaaatttaaatgtttagccaaatttattgtcatggtggctacgagaagaggcattgataacaagtttcaacagccaaatccttttttacagagatttcagatgagcgtgttttcagtgatgaggaaatttcacgtttttagtacagtgaattatgtacttttttttcctgtaatcattcactgattccaagttcacgggcagcctgtgactaggtcctcagcgtgacagcatcaccctctttcttcccttttccatggtactgttttgtgaccctttaaactcaaagggaagccttatctgtggctgcttcagggcagtccttcctcgttgagtggccagtgccctgggtaaccaggtggctgaagtgattggtcagttatgtggactgcgttttgtgcagtgtgtgagttatgactcatcgggaatgggagatgctggggttccaacccttcacgtcaccaaaggggaagtaatagtgtggagttctgaggagggtttgataagttgaataaggaaaggctaagataatttacaggttaccaactcatgtggggaaggtcttactgccatggtgcttttcaggggcctgtgtgtacacacatgattaaatggatttgcctgtgggaggtatgggcaggagaggaacccttaccattccagtaaatagcagtttctgcaattctgttgaatatgaaatgccatagagctttatttatttatgtaagtaaaagctaaatgaggggccaggtgcagtggctcacatctgtaatctcaacactttgggaggccaaggtgggaggatcacttgagcccaggagtttgagaccagcctgggcaacacagggagaccccgtctctataaaacatttagaaagttggctgggcatgctggggcatgcccatagtcccagctactcaggaggctgaggtgggaggattgcttgagccctggaggtcaaggctgcagtgagccatgattgcaccactgcactccagcctgggtgtcagagcgagaacccgtgtcataaataaataaagctacatgaaagattgatagaatattttagattatttattggccaaaagtttttaaaactcatatttggaagcaaaatgaaaagcaagtaaaatgttttaaatggttcatggaaaacgtatttgggtagaaggcaactcgtgcttccggaaggggttccctgtcctccatgtgtccacatggcggtcaggtagggacgacctgttctgtaaagtccttggcactgctgaatctgtggcatcatagaaggccctggagcttccccgttcctttcagtcagggactccatatagagtctcatgtggacgtctcccgtgctttcctcttgacctctacagtcacacttctgttaacatctggtaactgtgggcaacctgactgatgccgtcttggcaattgaggtccagaagatgatagttccgcaacgcaagcagtacctactttttttcttcatctatgcattgactctcagattaccatgcagagcttcacgttatcatccacgttaagtagtgctaggtaggaccttagagatgttcatgagaaactatttgttatgactttcctttgtatctttccttttaatttaaactttaatgataatgtacttttaatatggattctattcacatttgttttaaaaaccttgtaaatatgaatgtttaagacaacttactgcaagggtaattcaagtttacatgatttttaaatttgcaatgatgttttttttattctgtgtattgaaaaaaattttctgttaccaaattttacaacttctaataagactactataactttatgtaaactgatgaagatgtgctgattaacatattctgtgatatggtttacaacttttaatcataattgtccatgattttggaatgctgttatttatcagtaaatgtaaaatatttgaggcatttagccatacacacactagaactttttaaaactttgtcctatagtgtaattataaactgatgactattatcttcatacattgagtcttcatgcatcaatgaaatgaaaaatataggattatttatttactttttgtaactaagtgggaaataagaaaaaaagttagaaagtacttaaggggaaaatcgttcttactaagtcatgtattttcaacttgtcttccctggtatatcataaataccgacatattacataccccatgtaaaattttgcttaaactctctagcacttggcatgtagaatatgtaccataggtatcaggttaaaacactaaagtctgccagaaacttttgacagtagcaagaaaattgttgaagaaaaaataaattatttactgagggtagttatgttaaagttttgcgaacttaaagggctgactttagttccttcatggtaatggcttgagtaacatcatctttgggattttttaaatactggtccagtctaggagaacctggaagatgaccagaggtatttcagtttccctagggagagcttcgttatccatgtggatgataagtctgcttgatttattattaaatcattatagcagtgaagtggtgccattttctctctcttaagccccatttgaaaggctagagaaggggatatatatactatgttcaaggtttgtaaggttgttaatgtacataattgcagattgcaataaaagcttagatacattttgtaaacccaacccactaaatgagcaggttacaagacaaatgtcaccagcctcaagtattttatgaactatttactgagggtagttatgttaaatagattataatgtggtaaattatttcctgaatcctttatcacaggaaaaacacagaccctcataaaagggataattaaaacggatgtgtctgaacatttagtgaagatgagacttaaaacatgaaagtgtatttgtgtattttgagggttttagaaaccggttgccttagaggttagacttttgaagaaaaaaaaaaaaagatacagatcttttcccctggccaaagggaagttgtattagtctgtgacatcttgtgatgctgtttatcttggtttgacattggagatacgctagtaactgtgataccatactataaaacagaagaattttctgctactaaaaactgcctttttacaaaatgactgtaaatatttgtaaaataaaataacactaaactttaagcccaaaaggagagatagagccatgtgttcagttgtggacctgtccgtggggcacagtgccaccccatcacagtgttgctgtcatcaggcaaaagtgaatgtttgtttatggcaaattcgtcttttgcgaatggcttaattctgacactacctttctgggaaatgttaataaatttttaatattc

SEQ ID NO: 32360 - DNA, 4178 bp, Homo sapiens
gagctgaaagtcttggtttggccttgggttccgctgtaggggaggtcccgtgcgaaagaatgaggagatcctggggccttacctactagcggaatcgactgaagagacgcctgccagtgcgggaggtaggaagctcgatccccaaagaaaagagcgagtgggcaggcagctgcgagacagaaccggagtgtgcagggtccctagaggccggttcctggtctgtgctgctctcctggaagccatggtacaggcagagctcagggcgatccccaggtgagggcagcggctctgcctgggattccaccgcagtacaaccgggtagatgcggggtggagaagaaaggatgttgcctgcactgctcgccaatagcaccctgagaggctacatttgcagaagcagcagcagcagaagacacagcgccggtccaggaggcggctcgagctgttcgtaaagtcgcccgacagctttttctccgtagtatgcgagttgacaaaacagccagagaacagggctccccattacaatcttttcgagatcttttcccttgctaaccggatctgatttgtgcgaaaacatgccttgcacttgtacctggaggaactggagacagtggattcgacctttagtagcggtcatctacctggtgtcaatagtggttgcggttcccctatgcgtgtgggaattacagaaactggaggttggaatacacaccaaggcttggtttattgctggaatctttttgctgttgactattcctatatcactgtgggtgatattgcaacacttagtgcattatacacaacctgaactacaaaaaccaataataaggattctttggatggtacctatttacagtttagatagttggatagctttgaaatatcccggaattgcaatatatgtggatacctgcagagaatgctatgaagcttatgtaatttacaactttatgggattccttaccaattatctaactaaccggtatccaaatctggtattaatccttgaagccaaagatcaacagaaacatttccctcctttatgttgctgtccaccatgggctatgggagaagtattgctgtttaggtgcaaactaggtgtattacagtacacagttgtcagacctttcaccaccatcgttgctttaatctgtgagctgcttggtatatatgacgaagggaactttagcttttcaaatgcttggacttatttggttataataaacaacatgtcacagttgtttgccatgtattgtctcctgctcttttataaagtactaaaagaagaactgagcccaatccaacctgttggcaaatttctttgtgtaaagctggtggtttttgtttctttttggcaagcagtagttattgctttgttggtaaaagttggcgttatttctgaaaagcatacgtgggaatggcaaactgtagaagctgtggccaccggactccaggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggacggacagtcaggggacatcccaggaaaaaattgtttcccgaggatcaagatcaaaatgaacatacaagtttattatcatcatcatcacaagatgcaatttccattgcttcttctatgccaccttcacccatgggtcactaccaagggtttggacacactgtgactccccagactacacctaccacagctaagatatctgatgaaatccttagtgatactataggagagaaaaaagaaccttcagataaatccgtggattcctgaacagtatggaaaagcaaactgtgcaactactacattatatcattacctggtatcccatggattttgtgcttgggacagaccataaatgatggaaaatgtcaacacaaaaatagctgaaagccaggtacaactactgcatttatatatgtaagttttgtatatcaaaaataattggtctaaatttcctagacttagacttgatttcttaacattagggtatcgcatactcaaatggtagacaatgaccccaactaaatcttcctgatgttacactgctttatcaagaggatggacttttttttttttgagacagacagagtcttgctctgtcacccaggctggagtgcagtggcgcaatctcgggtcactgcaagctctgcctcccaagttcatgccattctcctgcctcagcctcccaagtagctgggactacaggcacctgccaccatgcccagctaattttttttttttcagtagagacagggtctcaccatgttagccaggatggtcttgatctgacctcgtgatccgccgacctcggcctcccaaagtgctggaattacaggcgtgagccactgcgcctggccaagaatggacattttttaaaaaaacatcagtacttcctaccactgctgcatgagtataatgctccggaattatcagaaagcataatgcagaaatacgaattagtggaacttaatcatgtgccatataagcttacctaacaaacagttatatccctattcctcaactgaatgtctttcaataaataagaatttatcatttattttctgcaacttttttatgtctcattctttaaacattaaaaacccttaatattttaacaaaaatttcttgattagaggcacagtgaaaaagaagtcaaaaaaaaaagttctacttttcatcagtgctattaaaggtggcagcaaatgtaaatcttggctgaatggtcttaattactcattaaaccacagtcagaaagacatataggtgctatttgggaaaactttttattacctaggatggggtttctctaattgctaatcacaaccccactgggtcatgtttgacattttataatgaaaataaaacagaaagtgccatagtatgttacagaaagcaaagatgagtattgtttctcaaagcctttgctttatgtatttatacacatactcattcatatctatctatatatatagagagagatagtggttcacagtaatcatacaaagtctttattccatccactattataaacatttctattaaaactaaaactgggctctatgtaaaaaccccaaagatacacacacaaaaaaaatctgtttgttagaactcaagtgaattcagtaaagttgcagaatacaaaatcaacatacaaaaagcattagcatttttatacataaataatgaaaataatgacctaactgaaaaattaagatgccatttatgatagcataaaaaaaatacttacttaggaataaatttaacaccaaggcagtaaaagatctgtatgtacactgaaaactatgaaacactgatgaaagaaagacacaaataaatggaaaggtatcccgtgctcatggatcagaataatactgttaaaatggtcacactacccaaagcaattcagaatcaatgcaatcctatcaaaattccaatggcattatttacacaaacagaaaaaaatcctaaaattcatatgtaacgataaaagaccctgaataggcaaaagaatactgaggaaaaaatgttggagacatcacatttcctaattataaattatactacaaaactatagtaatcaagacagtatggtactggtataaaaacacatacacaggccagtgggacagaagaaagagtccagatataaatccaaacatacacagtcaactaatttttgacaaagacaccaagaagacacatcggggaaagaacagtcttcattaagtgttcttaatgaagatgctgggaaaactgcacttccacatgcaaaacaatgaaatcagacccttatcttagacctacacaacaatcaattcaaaatggataaaagacctaaatgtaagaccagaaactatagaagagaacataggagaaaagttcctggacactgacccttggcaatgattttttggatatcacaccaaaagctcagtcaacaaaaacaaaaacaaatgtgactacatcaaaccaaaaagcttctgacagtaaaagaaacagtcaacaaaatgaaacagtagcctacagattgagtaaaaaatatttgtaaggcatatat

SEQ ID NO: 32361 - DNA, 6523 bp, Homo sapiens
cggcccagccgagccgggctgcttgtctggccggcggaggctgagcgcgaccctagcaagccgcggcgcccgccgaccagggacaagagcgactcctgggaccccactctgccccgcgccgccgcctcctcccctgttgtcgcggggacgctcaggcccgcgccgcccgggccacgattctcctcctctttctcccggaggggaaggaacggagaaagccgagcggcggctccgggagagagcgagccgaggcccctgcccccgaggctcggggcaggaggaggaggaggaggaggaggcggaggcggagggaagtgcgcgtcactctcgggaggagagtatttcacctccaggcagaggctgcggctgccagttgagtacgagcggcagctgcgggcgccggcaatcgagtggcttcctggccatggagaggagatctggacccgaggacgccagggactcctctccgtctccctggaccgctgtgtaggcacctgagttaacggacgctaagcggggtaggggaagtaacagtgtatcatgtatgccactgattccaggggacactcccctgctttcctccaacctcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaaggcgtttctctttcaggattccgggtagaggttgtagatggagtgaagctaaatttgctagatgatgttagtagttggaaacctggagaccagattgtggtcgcaagcacagactattccatgtaccaagcagaggagttcactcttcttccctgttctgaatgcagccattttcaggtcaaagtcaaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttctaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgttttttttttttgtatattgatgaatgagatcttacctattaaatatattattggattatggttcctgaaggtcattagagtgtgtgtgtgtgtgtgtgtgtgtgtgtgtgttttatgacttaaatatctttacgtgtgttttttagagcttggttctttaaagatttggagaagatatgtaaattaccaaggcacttggtttttctgttttatatactaataatcagggcctaagttaaataaaaatatgtgtgcatgtatttta

SEQ ID NO: 32362 - DNA, 5217 bp, Homo sapiens
gttaacggacgctaagcggggtaggggaagtaacagtgtatcatgtatgccactgattccaggggacactcccctgctttcctccaacctcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagagg

SEQ ID NO: 32363 - DNA, 1437 bp, Homo sapiens
cacttagtctggcacagatcacagaatctcccttttcaaagttgagacacttgactttgtgctgaaaatgtctttttagctgtttaaattttcattctcttccctttacttcttgattattttttcaaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaa

SEQ ID NO: 32364 - DNA, 533 bp, Homo sapiens
accacttcacttgtgtgtgaacataagaagtatgactctgaaatgaatgcttcatgacagcaaggatcatgtctttctttcttgttcaacaccctatgtccagtgccttgaacagttcctgacccatgattttctgaaaactttactcctttgctgcacttcaagtctgcaaaattgacaaatgaaagtgtcggggcagttggggagaaagaggccttcagatatactctataaatcatcaaaatatgatgtgctatatattctcggcataaactggaaatgaaaaaaacttgctacaaataggagtgactcctttgggcttaaattggattggcagcaacacagattctgctgtggattgaagtcattttctacctcggcactactcagtccatggggaatggtgaagttatgattttgcagcaagattctgggagcaggccagcatctacatctgttctaaacttaacagtgtatcatgtatgccactgattccaggggacactcccctgctttcctccaacctcagaatg

SEQ ID NO: 32365 - DNA, 1295 bp, Homo sapiens
ggctcagctgggaggcgggacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggtgggatcggtgtcctcgggatgagatttggcgtttcctcggggctttggtgggatcggtgtcctcaggatgagatttagggtttcctcggggctttcgggatcttcacctaatatccggtattattttatgagaggagtggtcttggctgtcagaactggatccctggggtgatatttgggaattagtggagtgatctctgaagacctagggctatgatctggagctgctgtggctgaaatttggggcctctgaagtggcatggagattgaggtccagagagcctgagatcttgagggctgacatttggagagatggggtcgagggttgtctttgggccttgactgctttgggcctttctcactctcattcccgggatgctttgccagaatctctgctggattggccgtaaccctgtccccgagcgggctcacagggtctgaaggccacgcatgaggcaaaggtaaagttctgagccacccggtgcctccttcccaggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaatg

SEQ ID NO: 32366 - DNA, 916 bp, Homo sapiens
ggctcagctgggaggcgggacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggtgggatcggtgtcctcgggatgagatttggcgtttcctcggggctttggtgggatcggtgtcctcaggatgagatttagggtttcctcggggctttcgggatcttcacctaatatccggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaatg

SEQ ID NO: 32367 - DNA, 787 bp, Homo sapiens
agctgggaggcgggacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcag

SEQ ID NO: 32368 - DNA, 1306 bp, Homo sapiens
acttccgcccaacgcccggtagtctgagagcctccaaggtcctcccccgcacccctgaggtcctgcagacgacggcgtcgtgggtggtcaccgttatcccttaggtctggagaggggacatccgagcgagggccacttgcggccaggcccgagctcgtccagctccgggtgaccacagagtgccgcgggcgggcagaggggccggaaacccaggccgcttcgtccctgtttccggcagcgccgcgctgctccgggagccgctgtggcagcgtatgctgccacggggactgaagatggcgccgcgaggtaaacggttgtcctccaccccgctggaaatcctgttctttctgaacgggtggtataatgctacctatttcctgctggaacttttcatatttctgtataaaggtgtcctgctaccatatccaacagctaacctagtactggatgtggtgatgctcctcctttatcttggaattgaagtaattcgcctgttttttggtacaaagggaaacctctgccagcgaaagatgccgctcagtattagcgtggccttgaccttcccatctgccatgatggcctcctattacctgctgctgcagacctacgtactccgcctggaagccatcatgaatggcatcttgctcttcttctgtggctcagagcttttacttgaggtgctcaccttggctgctttctccagtatggacaggatttgaagtacagaatttcagccagcagcccatcaggctgacaccacacatattgcttctggtactttagccacaccagtgagaattggtggggcaagttgtcctgagaaaggctgtgtggcttttcttcagcacagacatttgggcaagcaactcagcataaggccagtgggtaccatcttctaaaccaggaccatcagcccaagagactcttctacactccagtatagggaggggcaaggttattcccatcctgccccttctcagaaccagtcccctgctgacctcaagttctcctccttgatcaccgtggccagagcatctcgtgtggaccatctaggctccttgggcttcaagcaggacctgagccacatgctccctgtacgagctgtgctatacctgtcccacatgagcacggagagcctcatgttggtgggtttccagagtgatgtgaaagcctctcaccccaatcctcggagactgagttccacaacttttttagtagctcatagtgttatttttctactctcttcatgaaactaactttattttataataaatatgtattttctgttgtgggggttgcagccttt

SEQ ID NO: 32369 - DNA, 1955 bp, Homo sapiens
cagttttctgtttttttttttttttgagacagagtctcactgtcgcccaggctggagtgcggtggcgcgatctcagctcactgcaacctccgcctcccgggttcgagcgattctcctacctcagcctcccaagtagctgtaactactggcgcgcgccagtacgcccggctaatttttgtatttttagtagagacggggtttcgccatgttggccaggctgatttcgaactcctgacctcaggtgatccatcacctcggcctcccaaagtgctgggattacaggcgtgagccactaagcccggccagcaacacgcttttaccgctgcaaatccggatcaggcaggctttgaagcccagctcacaggccgtctcttggaaactaacttagatttccacctgggagcactttgtcctctcagctcccactgcaccactttatggatcgcgtggtgactcgtttcattttatttatgtgtgttcctggaaaggacgctctatttccttcgtgtctctacctggtaggtaaatcggccgcagaaaagaccaatgctaactccaccctgcatttgcagagatccgtcgctcacaccttttcttgtcttccgttgaaaaaagagaatcgtgggagtaggacctatttgccaatctcctggtaacactatcacaactggccacttccgcccaacgcccggtagtctgagagcctccaaggtcctcccccgcacccctgaggtcctgcagacgacggcgtcgtgggtggtcaccgttatcccttaggtctggagaggggacatccgagcgagggccacttgcggccaggcccgagctcgtccagctccgggtgaccacagagtgccgcgggcgggcagaggggccggaaacccaggccgcttcgtccctgtttccggcagcgccgcgctgctccgggagccgctgtggcagcgtatgctgccacggggactgaagatggcgccgcgaggtaaacggttgtcctccaccccgctggaaatcctgttctttctgaacgggtggtataatgctacctatttcctgctggaacttttcatatttctgtataaaggtgtcctgctaccatatccaacagctaacctagtactggatgtggtgatgctcctcctttatcttggaattgaagtaattcgcctgttttttggtacaaagggaaacctctgccagcgaaagatgccgctcagtattagcgtggccttgaccttcccatctgccatgatggcctcctattacctgctgctgcagacctacgtactccgcctggaagccatcatgaatggcatcttgctcttcttctgtggctcagagcttttacttgaggtgctcaccttggctgctttctccaggatttgaagtacagaatttcagccagcagcccatcaggctgacaccacacatattgcttctggtactttagccacaccagtgagaattggtggggcaagttgtcctgagaaaggctgtgtggcttttcttcagcacagacatttgggcaagcaactcagcataaggccagtgggtaccatcttctaaaccaggaccatcagcccaagagactcttctacactccagtatagggaggggcaaggttattcccatcctgccccttctcagaaccagtcccctgctgacctcaagttctcctccttgatcaccgtggccagagcatctcgtgtggaccatctaggctccttgggcttcaagcaggacctgagccacatgctccctgtacgagctgtgctatacctgtcccacatgagcacggagagcctcatgttggtgggtttccagagtgatgtgaaagcctctcaccccaatcctcggagactgagttccacaacttttttagtagctcatagtgttatttttctactctcttcatgaaactaactttattttataataaatatgtattttctgttgtg

SEQ ID NO: 32370 - DNA, 1378 bp, Homo sapiens
acgaagccccggcgtcccacaggtcccggaggccgctgcgtcgcggggagctgggctcgggccgccggcggttgcgccggggcagccccgcggggagagcaccatgaggactgactcgggggctcggctggaggagggccacctgcgtcctccacgagctcttccacctgtgccaagtatagatgatattccacttagtcgtcctaagaaaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagt

SEQ ID NO: 32371 - DNA, 5592 bp, Homo sapiens
ttcccgcaaacaaatcaccgccaccacttaggaaaccacgggaaagctgtgattgcagcgccacggtcgccagatttctgctcctgggcacattacccccaactccgaggccccctttttggcagggctagtctggactggccaatccaggtccctgcacgcctctcaccgcaacatccccgcagggcgctgcgcgcggggtactagccaggcggcgcggcccgatgacgcattgcgcctgcgcgcgcgaccgagccgggaggggtggggcgccaggtgcttgggggccggcggccgccgaggccggctaaacgcagaatggggaagaatcctgtgcgtcctccacgagctcttccacctgtgccaagtcaagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttgaaaaattatataacctaaattttttacctagaagtaactaaaaagttgcttctcattataatctgtactagtggttctcatatctggttgtacatcaggatcatagagggagattttaaaaatctatgtagcaaaagaggctgagcagggcaaggctcaggggaataaaggagagacctgtgagcttgtgggctcccagttgacatctgcagtaccctttcctctgtcccttttttctgagtgacaagaaataggagtagaaattcaccatctctgttctccagctctttgtcagagaggtttctggttttccaggaaatccccctcttgagatgggtcctgcactgggaaagatctcttcagaactatatccaatggtacctcagctgttgtatatgagaccctaaagctcaagttgaggagaagactagctatgggaaaaaatgtttcaaaggctgttgagcacatcaataaaactattgagcctgccctgattagcaagcacctgaatgttatagaacagaagaggattgacaaattgatgatagagacagttgaccctgacaataggtctaaatttggagtgaacattatactgggaatctcttttgctgtttgtaaggctggagctgccgaaaagggattctccctgctgtcacagaattgtgaatttgctggcaattctgaaggcatcctgctagttccagctttcactgtgaccagcaatggttctcaatctggcaataagctggcagtataggagttcataatcttccccgtcagcaaacttcagggaagccatgctcgttagagccaaggcttagcacacttgagccgtgtcatcaaagagaaatgtgagaaagctgctgccaatgtgggggattgtggtaggctgcataatgtctcctaaagatgtccatgtcctaatccctggaacttgtgaatatactactttacttggccaaagggatttgcagatatgattaaggttatgaaccttaaaacggggacattatcctgtattatccagaagggtccagtgtaatcttatgagtccttaaaagcagagaagaaagccttttatgtctgtggtcagagaggtcagaagttatgatattgctggctttgaagatggaagagggggccatgagccaaggagagtgatgaccttgcagctgagtacggcccttggccaacaatgagcaaggaaatggatttcagtcacataaccacaaggaactgagttctatgagtatcccaaatgagcaaggaaacaaatcctcccctagagccaagaaaggaaggcagctctgtggataccttggttttggcctggtgctgcccatgtcatacttttgacatacagaactgtaagatagcaagtgtatgttgactaagctgctaaattggtggtgattgcttatggcagcaatagaaagctatatatcctagagaataaagaaggctagagctgctgtggaatgcacttgggaaagctggctacattgataatatgtaactgccatgggcatagttgcctttgtattcttccaggtctgggaagtacaacttagacttcagatctcgtaatgacccaggaggcatataaacctgagcagctagtggccctgtacaagtccttcatcagggaaaaacattgagtattccctgattaaggacttgtacagaggactctgttttccctggtgtttctggtgtgtctcaaaaattgtttgactgtgatgacagggaagtttggaagaagttcactgctaatgcatgtctccaggaagcagggaatgatctcacagtgacacttgaggcacattgctgaggccgtcgatgagaattcatgtaactttctccagcttacagtggactagattgacatgcaagctgatccagtccaattggtagggcatcatggtttctcattactcactgacttaaaatacttttattgccatcctggtgaagcactgcactgggtagataacacaggggcaccttgctgatcagagcccttggccaggtacaaagagctcagtttctaaaactctgtcatttcaataatgttataaattgaatcatacagtatgtaattttatgggattcgctttttttctgttgatctctttttttctgagtcatctcagctgttgtgtgtatcaatagttcatttccttttactgttttgtttggtttaactcattgacctattgaaggatatctgggctcattccagtctgtgaataatgctgctgtggacattcatgtgcaagtttttgtgtgaacattaagttttcatttctttaagataaatgcccaggagtgaaactgatgggttgtatgtagttacaaactgccaagctgttttccagagttggcggtaccattctaatttcccatgacaattttttgaagagtccaagctagttgctttagagtgcctcacctacattttttaattgtctgactttttcctaatgacatcacttaatttgttcctcaatctcctgaatttcctatagactggaggttaggtctggtggtttgattagattttttaaaaaaatatgacttcatctgtgatgctgtgtactttatgttgcataacatgaaccctaagaacagagtgagctgctggacagcaagtttcatggggtgcagtaattaacacaccacatagtataaatctgaaataatgacaaatgtgttaagggccttgggatattgggccatgtactctgaggagcacaaggtgaggtgcaggttcctgcccctaaagaactctatcttttgagattagcaactaacagtgtgagcccactaataggatgtgaaagttgtcaaaatcaagttctggtcattgtgttaaaaatcctaacaaatagagctggggaaggccgtgaaaggacgattttcatgcacagatgtctgataatgaggactatcattaaaagactgcacaaaaccacaccttgcacaaaggccatcacaacctgacacacacaaaaaatacttctatgaggacatttgcccagcaactccctgtccaatgtccaactggcaacatccttgttattgatccttgtagccaaggataattctctcaaaacaatcatttttgctttaaaaaccgttgtcttccttgacctccctgtatatgcacatagtttactgtggcacttgtattcttattgcaatgcctactcctgaataaacatcattttctttcagagagtctccctctctgttatttaggctgacaaggatatgccaagaagtagcttggatatagcagttaactctgcctttaggatatgtgtatggggatataagagttaactaaaagctgacctttgagttggtccttgaataaaagaagaatagattccaaaaataagaggaataaataatgatcctgagctaggagagtacattttgcagacctttggtttccatattaagaaattcagatttttatgtacaataaagaagttctggaattctctg

SEQ ID NO: 32372 - DNA, 5415 bp, Homo sapiens
cctcgccaggcgccacgaagccccggcgtcccacaggtcccggaggccgctgcgtcgcggggagctgggctcgggccgccggcggttgcgccggggcagccccgcggggagagcaccatgaggactgactcgggggctcggctggaggagggccacctgcgtcctccacgagctcttccacctgtgccaagtcaagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttgaaaaattatataacctaaattttttacctagaagtaactaaaaagttgcttctcattataatctgtactagtggttctcatatctggttgtacatcaggatcatagagggagattttaaaaatctatgtagcaaaagaggctgagcagggcaaggctcaggggaataaaggagagacctgtgagcttgtgggctcccagttgacatctgcagtaccctttcctctgtcccttttttctgagtgacaagaaataggagtagaaattcaccatctctgttctccagctctttgtcagagaggtttctggttttccaggaaatccccctcttgagatgggtcctgcactgggaaagatctcttcagaactatatccaatggtacctcagctgttgtatatgagaccctaaagctcaagttgaggagaagactagctatgggaaaaaatgtttcaaaggctgttgagcacatcaataaaactattgagcctgccctgattagcaagcacctgaatgttatagaacagaagaggattgacaaattgatgatagagacagttgaccctgacaataggtctaaatttggagtgaacattatactgggaatctcttttgctgtttgtaaggctggagctgccgaaaagggattctccctgctgtcacagaattgtgaatttgctggcaattctgaaggcatcctgctagttccagctttcactgtgaccagcaatggttctcaatctggcaataagctggcagtataggagttcataatcttccccgtcagcaaacttcagggaagccatgctcgttagagccaaggcttagcacacttgagccgtgtcatcaaagagaaatgtgagaaagctgctgccaatgtgggggattgtggtaggctgcataatgtctcctaaagatgtccatgtcctaatccctggaacttgtgaatatactactttacttggccaaagggatttgcagatatgattaaggttatgaaccttaaaacggggacattatcctgtattatccagaagggtccagtgtaatcttatgagtccttaaaagcagagaagaaagccttttatgtctgtggtcagagaggtcagaagttatgatattgctggctttgaagatggaagagggggccatgagccaaggagagtgatgaccttgcagctgagtacggcccttggccaacaatgagcaaggaaatggatttcagtcacataaccacaaggaactgagttctatgagtatcccaaatgagcaaggaaacaaatcctcccctagagccaagaaaggaaggcagctctgtggataccttggttttggcctggtgctgcccatgtcatacttttgacatacagaactgtaagatagcaagtgtatgttgactaagctgctaaattggtggtgattgcttatggcagcaatagaaagctatatatcctagagaataaagaaggctagagctgctgtggaatgcacttgggaaagctggctacattgataatatgtaactgccatgggcatagttgcctttgtattcttccaggtctgggaagtacaacttagacttcagatctcgtaatgacccaggaggcatataaacctgagcagctagtggccctgtacaagtccttcatcagggaaaaacattgagtattccctgattaaggacttgtacagaggactctgttttccctggtgtttctggtgtgtctcaaaaattgtttgactgtgatgacagggaagtttggaagaagttcactgctaatgcatgtctccaggaagcagggaatgatctcacagtgacacttgaggcacattgctgaggccgtcgatgagaattcatgtaactttctccagcttacagtggactagattgacatgcaagctgatccagtccaattggtagggcatcatggtttctcattactcactgacttaaaatacttttattgccatcctggtgaagcactgcactgggtagataacacaggggcaccttgctgatcagagcccttggccaggtacaaagagctcagtttctaaaactctgtcatttcaataatgttataaattgaatcatacagtatgtaattttatgggattcgctttttttctgttgatctctttttttctgagtcatctcagctgttgtgtgtatcaatagttcatttccttttactgttttgtttggtttaactcattgacctattgaaggatatctgggctcattccagtctgtgaataatgctgctgtggacattcatgtgcaagtttttgtgtgaacattaagttttcatttctttaagataaatgcccaggagtgaaactgatgggttgtatgtagttacaaactgccaagctgttttccagagttggcggtaccattctaatttcccatgacaattttttgaagagtccaagctagttgctttagagtgcctcacctacattttttaattgtctgactttttcctaatgacatcacttaatttgttcctcaatctcctgaatttcctatagactggaggttaggtctggtggtttgattagattttttaaaaaaatatgacttcatctgtgatgctgtgtactttatgttgcataacatgaaccctaagaacagagtgagctgctggacagcaagtttcatggggtgcagtaattaacacaccacatagtataaatctgaaataatgacaaatgtgttaagggccttgggatattgggccatgtactctgaggagcacaaggtgaggtgcaggttcctgcccctaaagaactctatcttttgagattagcaactaacagtgtgagcccactaataggatgtgaaagttgtcaaaatcaagttctggtcattgtgttaaaaatcctaacaaatagagctggggaaggccgtgaaaggacgattttcatgcacagatgtctgataatgaggactatcattaaaagactgcacaaaaccacaccttgcacaaaggccatcacaacctgacacacacaaaaaatacttctatgaggacatttgcccagcaactccctgtccaatgtccaactggcaacatccttgttattgatccttgtagccaaggataattctctcaaaacaatcatttttgctttaaaaaccgttgtcttccttgacctccctgtatatgcacatagtttactgtggcacttgtattcttattgcaatgcctactcctgaataaacatcattttctttcagagagtctccctctctgttatttaggctgacaaggatatgccaagaagtagcttggatatagcagttaactctgcctttaggatatgtgtatggggatataagagttaactaaaagctgacctttgagttggtccttgaataaaagaagaatagattccaaaaataagaggaataaataatgatcctgagctaggagagtacattttgcagacctttggtttccatattaagaaattcagatttttatgtacaataaagaagttctggaattctctg

SEQ ID NO: 32373 - DNA, 5364 bp, Homo sapiens
atgacgcattgcgcctgcgcgcgcgaccgacgggaggggtggggcgccaggtgcttggggcggcggccgccgaggccggctaaacgcagaatggggaagaatcctgtgcgtcctccacgagctcttccacctgtgccaagtatagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttgaaaaattatataacctaaattttttacctagaagtaactaaaaagttgcttctcattataatctgtactagtggttctcatatctggttgtacatcaggatcatagagggagattttaaaaatctatgtagcaaaagaggctgagcagggcaaggctcaggggaataaaggagagacctgtgagcttgtgggctcccagttgacatctgcagtaccctttcctctgtcccttttttctgagtgacaagaaataggagtagaaattcaccatctctgttctccagctctttgtcagagaggtttctggttttccaggaaatccccctcttgagatgggtcctgcactgggaaagatctcttcagaactatatccaatggtacctcagctgttgtatatgagaccctaaagctcaagttgaggagaagactagctatgggaaaaaatgtttcaaaggctgttgagcacatcaataaaactattgagcctgccctgattagcaagcacctgaatgttatagaacagaagaggattgacaaattgatgatagagacagttgaccctgacaataggtctaaatttggagtgaacattatactgggaatctcttttgctgtttgtaaggctggagctgccgaaaagggattctccctgctgtcacagaattgtgaatttgctggcaattctgaaggcatcctgctagttccagctttcactgtgaccagcaatggttctcaatctggcaataagctggcagtataggagttcataatcttccccgtcagcaaacttcagggaagccatgctcgttagagccaaggcttagcacacttgagccgtgtcatcaaagagaaatgtgagaaagctgctgccaatgtgggggattgtggtaggctgcataatgtctcctaaagatgtccatgtcctaatccctggaacttgtgaatatactactttacttggccaaagggatttgcagatatgattaaggttatgaaccttaaaacggggacattatcctgtattatccagaagggtccagtgtaatcttatgagtccttaaaagcagagaagaaagccttttatgtctgtggtcagagaggtcagaagttatgatattgctggctttgaagatggaagagggggccatgagccaaggagagtgatgaccttgcagctgagtacggcccttggccaacaatgagcaaggaaatggatttcagtcacataaccacaaggaactgagttctatgagtatcccaaatgagcaaggaaacaaatcctcccctagagccaagaaaggaaggcagctctgtggataccttggttttggcctggtgctgcccatgtcatacttttgacatacagaactgtaagatagcaagtgtatgttgactaagctgctaaattggtggtgattgcttatggcagcaatagaaagctatatatcctagagaataaagaaggctagagctgctgtggaatgcacttgggaaagctggctacattgataatatgtaactgccatgggcatagttgcctttgtattcttccaggtctgggaagtacaacttagacttcagatctcgtaatgacccaggaggcatataaacctgagcagctagtggccctgtacaagtccttcatcagggaaaaacattgagtattccctgattaaggacttgtacagaggactctgttttccctggtgtttctggtgtgtctcaaaaattgtttgactgtgatgacagggaagtttggaagaagttcactgctaatgcatgtctccaggaagcagggaatgatctcacagtgacacttgaggcacattgctgaggccgtcgatgagaattcatgtaactttctccagcttacagtggactagattgacatgcaagctgatccagtccaattggtagggcatcatggtttctcattactcactgacttaaaatacttttattgccatcctggtgaagcactgcactgggtagataacacaggggcaccttgctgatcagagcccttggccaggtacaaagagctcagtttctaaaactctgtcatttcaataatgttataaattgaatcatacagtatgtaattttatgggattcgctttttttctgttgatctctttttttctgagtcatctcagctgttgtgtgtatcaatagttcatttccttttactgttttgtttggtttaactcattgacctattgaaggatatctgggctcattccagtctgtgaataatgctgctgtggacattcatgtgcaagtttttgtgtgaacattaagttttcatttctttaagataaatgcccaggagtgaaactgatgggttgtatgtagttacaaactgccaagctgttttccagagttggcggtaccattctaatttcccatgacaattttttgaagagtccaagctagttgctttagagtgcctcacctacattttttaattgtctgactttttcctaatgacatcacttaatttgttcctcaatctcctgaatttcctatagactggaggttaggtctggtggtttgattagattttttaaaaaaatatgacttcatctgtgatgctgtgtactttatgttgcataacatgaaccctaagaacagagtgagctgctggacagcaagtttcatggggtgcagtaattaacacaccacatagtataaatctgaaataatgacaaatgtgttaagggccttgggatattgggccatgtactctgaggagcacaaggtgaggtgcaggttcctgcccctaaagaactctatcttttgagattagcaactaacagtgtgagcccactaataggatgtgaaagttgtcaaaatcaagttctggtcattgtgttaaaaatcctaacaaatagagctggggaaggccgtgaaaggacgattttcatgcacagatgtctgataatgaggactatcattaaaagactgcacaaaaccacaccttgcacaaaggccatcacaacctgacacacacaaaaaatacttctatgaggacatttgcccagcaactccctgtccaatgtccaactggcaacatccttgttattgatccttgtagccaaggataattctctcaaaacaatcatttttgctttaaaaaccgttgtcttccttgacctccctgtatatgcacatagtttactgtggcacttgtattcttattgcaatgcctactcctgaataaacatcattttctttcagagagtctccctctctgttatttaggctgacaaggatatgccaagaagtagcttggatatagcagttaactctgcctttaggatatgtgtatggggatataagagttaactaaaagctgacctttgagttggtccttgaataaaagaagaatagattccaaaaataagaggaataaataatgatcctgagctaggagagtacattttgcagacctttggtttccatattaagaaattcagatttttatgtacaataaagaagttctggaattctctg

SEQ ID NO: 32374 - DNA, 5399 bp, Homo sapiens
gaagccccggcgtcccacaggtcccggaggccgctgcgtcgcggggagctgggctcgggccgccggcggttgcgccggggcagccccgcggggagagcaccatgaggactgactcgggggctcggctggaggagggccacctgcgtcctccacgagctcttccacctgtgccaagtatagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttgaaaaattatataacctaaattttttacctagaagtaactaaaaagttgcttctcattataatctgtactagtggttctcatatctggttgtacatcaggatcatagagggagattttaaaaatctatgtagcaaaagaggctgagcagggcaaggctcaggggaataaaggagagacctgtgagcttgtgggctcccagttgacatctgcagtaccctttcctctgtcccttttttctgagtgacaagaaataggagtagaaattcaccatctctgttctccagctctttgtcagagaggtttctggttttccaggaaatccccctcttgagatgggtcctgcactgggaaagatctcttcagaactatatccaatggtacctcagctgttgtatatgagaccctaaagctcaagttgaggagaagactagctatgggaaaaaatgtttcaaaggctgttgagcacatcaataaaactattgagcctgccctgattagcaagcacctgaatgttatagaacagaagaggattgacaaattgatgatagagacagttgaccctgacaataggtctaaatttggagtgaacattatactgggaatctcttttgctgtttgtaaggctggagctgccgaaaagggattctccctgctgtcacagaattgtgaatttgctggcaattctgaaggcatcctgctagttccagctttcactgtgaccagcaatggttctcaatctggcaataagctggcagtataggagttcataatcttccccgtcagcaaacttcagggaagccatgctcgttagagccaaggcttagcacacttgagccgtgtcatcaaagagaaatgtgagaaagctgctgccaatgtgggggattgtggtaggctgcataatgtctcctaaagatgtccatgtcctaatccctggaacttgtgaatatactactttacttggccaaagggatttgcagatatgattaaggttatgaaccttaaaacggggacattatcctgtattatccagaagggtccagtgtaatcttatgagtccttaaaagcagagaagaaagccttttatgtctgtggtcagagaggtcagaagttatgatattgctggctttgaagatggaagagggggccatgagccaaggagagtgatgaccttgcagctgagtacggcccttggccaacaatgagcaaggaaatggatttcagtcacataaccacaaggaactgagttctatgagtatcccaaatgagcaaggaaacaaatcctcccctagagccaagaaaggaaggcagctctgtggataccttggttttggcctggtgctgcccatgtcatacttttgacatacagaactgtaagatagcaagtgtatgttgactaagctgctaaattggtggtgattgcttatggcagcaatagaaagctatatatcctagagaataaagaaggctagagctgctgtggaatgcacttgggaaagctggctacattgataatatgtaactgccatgggcatagttgcctttgtattcttccaggtctgggaagtacaacttagacttcagatctcgtaatgacccaggaggcatataaacctgagcagctagtggccctgtacaagtccttcatcagggaaaaacattgagtattccctgattaaggacttgtacagaggactctgttttccctggtgtttctggtgtgtctcaaaaattgtttgactgtgatgacagggaagtttggaagaagttcactgctaatgcatgtctccaggaagcagggaatgatctcacagtgacacttgaggcacattgctgaggccgtcgatgagaattcatgtaactttctccagcttacagtggactagattgacatgcaagctgatccagtccaattggtagggcatcatggtttctcattactcactgacttaaaatacttttattgccatcctggtgaagcactgcactgggtagataacacaggggcaccttgctgatcagagcccttggccaggtacaaagagctcagtttctaaaactctgtcatttcaataatgttataaattgaatcatacagtatgtaattttatgggattcgctttttttctgttgatctctttttttctgagtcatctcagctgttgtgtgtatcaatagttcatttccttttactgttttgtttggtttaactcattgacctattgaaggatatctgggctcattccagtctgtgaataatgctgctgtggacattcatgtgcaagtttttgtgtgaacattaagttttcatttctttaagataaatgcccaggagtgaaactgatgggttgtatgtagttacaaactgccaagctgttttccagagttggcggtaccattctaatttcccatgacaattttttgaagagtccaagctagttgctttagagtgcctcacctacattttttaattgtctgactttttcctaatgacatcacttaatttgttcctcaatctcctgaatttcctatagactggaggttaggtctggtggtttgattagattttttaaaaaaatatgacttcatctgtgatgctgtgtactttatgttgcataacatgaaccctaagaacagagtgagctgctggacagcaagtttcatggggtgcagtaattaacacaccacatagtataaatctgaaataatgacaaatgtgttaagggccttgggatattgggccatgtactctgaggagcacaaggtgaggtgcaggttcctgcccctaaagaactctatcttttgagattagcaactaacagtgtgagcccactaataggatgtgaaagttgtcaaaatcaagttctggtcattgtgttaaaaatcctaacaaatagagctggggaaggccgtgaaaggacgattttcatgcacagatgtctgataatgaggactatcattaaaagactgcacaaaaccacaccttgcacaaaggccatcacaacctgacacacacaaaaaatacttctatgaggacatttgcccagcaactccctgtccaatgtccaactggcaacatccttgttattgatccttgtagccaaggataattctctcaaaacaatcatttttgctttaaaaaccgttgtcttccttgacctccctgtatatgcacatagtttactgtggcacttgtattcttattgcaatgcctactcctgaataaacatcattttctttcagagagtctccctctctgttatttaggctgacaaggatatgccaagaagtagcttggatatagcagttaactctgcctttaggatatgtgtatggggatataagagttaactaaaagctgacctttgagttggtccttgaataaaagaagaatagattccaaaaataagaggaataaataatgatcctgagctaggagagtacattttgcagacctttggtttccatattaagaaattcagatttttatgtacaataaagaagttctggaattctctg

SEQ ID NO: 32375 - DNA, 2409 bp, Homo sapiens
ccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccagggcttctggctacccgggtggaagtgccactgctgggcattgttgtggctgctgggcttgcactgggcaccctcgtggggttcagcaccttggtggcctgcctggtctgcagaaaagagaagaaaaccaaaggcccctcccggcacccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccgttcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcatttaca

SEQ ID NO: 32376 - DNA, 1965 bp, Homo sapiens
agttgctccggcggcgctcggggagggagccagcagcctagggcctaggcccgggccaccatggcgctgcctccaggcccagccgccctccggcacacactgctgctcctgccagcccttctgagctcagtcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggcccctcccggcacccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccgttcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattc

SEQ ID NO: 32377 - DNA, 1456 bp, Homo sapiens
agcagttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccagggcttctggctacccgggtggaagtgccactgctgggcattgttgtggctgctgggcttgcactgggcaccctcgtggggttcagcaccttggtggcctgcctggtctgcagaaaagagaagaaaaccaaaggcccctcccggcacccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggaagaagaaatcaggacaaagacgcataacagagggaagaccatgggaagacacagaagatggccaagaagagacccctcagaagaaatcaatcttggtggggcgtggtggcttcacgcctgtaataccagcactgtgggaggttgaggtgggcagatcgcctgagcctaggagttcgagaccagcctgggcaacatggtgaaattccatctctacaaaaaaattagccgggtgtggtgttgagtatctgtagtcccagctacttgggaggctggggtgggaggactgcttgagtccagcaggttgaggctgcagtgagctgagattgagctactgcactccagcctgggcatagagtaataccct

SEQ ID NO: 32378 - DNA, 2395 bp, Homo sapiens
cggccgcccacctgccgggtaagggcccctcgggcccgtggtcgggcatcgattggccccgcctggcgcagcccccgcccctgcagcggactgcggtgctcatcagacctgagcagttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggcccctcccggcacccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccgttcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcattt

SEQ ID NO: 32379 - DNA, 2442 bp, Homo sapiens
gggggtactcggcgcgggctggggaccagccggggggtggtgagccgcggccgcccacctgccgggtaagggcccctcgggcccgtggtcgggcatcgattggccccgcctggcgcagcccccgcccctgcagcggactgcggtgctcatcagacctgagcagttgctccggcggcgctcggggagggagccagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggcccctcccggcacccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccgttcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcatttaca

SEQ ID NO: 32380 - DNA, 2228 bp, Homo sapiens
cggccgcccacctgccgggtaagggcccctcgggcccgtggtcgggcatcgattggccccgcctggcgcagcccccgcccctgcagcggactgcggtgctcatcagacctgagcagttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggcccctcccggcacccatctctgatatcaagtgactccaacaacctaaaactcaacaacgtgcgcctgccacgggagaacatgtccctcccgtccaaccttcagctcaatgacctcactccagattccagagtgaaaccagcagaccggcagatggctcagaacaacagccggccagagcttctggacccggagcccggcggcctcctcaccagccaaggaagaagaaatcaggacaaagacgcataacagagggaagaccatgggaagacacagaagatggccaagaagagacccctcagaagaaatcaatcttggtggggcgtggtggcttcacgcctgtaataccagcactgtgggaggttgaggtgggcagatcgcctgagcctaggagttcgagaccagcctgggcaacatggtgaaattccatctctacaaaaaaattagccgggtgtggtgttgagtatctgtagtcccagctacttgggaggctggggtgggaggactgcttgagtccagcaggttgaggctgcagtgagctgagattgagctactgcactccagcctgggcatagagtaataccctgtaaaaaaaaaggaaggaagggagggagggaatcaaccatgccaacaaattgatcttggactactactggactactagcctccagaactatgaaataatacatttctgatgtctaagccactcagtctatggtactttgttatggcagcctagcaaaataatacaacatgctattttttcccccgatcagtatggaattggtcatatgttttataggtaaaatacactgccatactcttttcctgtgggaatctgtgaaaaagaaactgataccaagttatgggcaagtattaacagttatatatgcattacttggtgttataatgcctaatgattccaggacaccatatgaacagagaaaatgggcatgacatctaactcaggtaacaggctctggatctaaacaagtcacagtgtgaagtttttaaactactggtttcttaaaacttttctctttttacaaaaaacagagtacatatagttctgcaacttgctgcaatttgcttttttcatttaacaacatatcactgatatttcttcatattagagcaaaataaggccaaataatattccattgcatagtatttcactgaatggatgtactgcaacctagctattcaatcccctaatcagacaccttcccctcaactacagcttcaaaatgctctgaggaaagagactgtttccaaattctgtgtgtttacaatcaattcttcatatacaaaaaaaatctgtctttgtagagcttacattttagtagggaagaacaaaataagtaaataaagtctatggtatg

SEQ ID NO: 32381 - DNA, 1410 bp, Homo sapiens
agttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccagggcttctggctacccgggtggaagtgccactgctgggcattgttgtggctgctgggcttgcactgggcaccctcgtggggttcagcaccttggtggcctgcctggtctgcagaaaagagaagaaaaccaaaggcccctcccggcacccatctctgatatcaagtgactccaacaacctaaaactcaacaacgtgcgcctgccacgggagaacatgtccctcccgtccaaccttcagctcaatgacctcactccagattccagagtgaaaccagcagaccggcagatggctcagaacaacagccggccagagcttctggacccggagcccggcggcctcctcaccagccaagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcattta

SEQ ID NO: 32382 - DNA, 935 bp, Homo sapiens
agacctgagcagttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaatggcttctggctacccgggtggaagtgccactgctgggcattgttgtggctgctgggcttgcactgggcaccctcgtggggttcagcaccttggtggcctgcctggtctgcagaaaagagaagaaaaccaaaggcccctcccggcacccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccgttcctcc

SEQ ID NO: 32383 - DNA, 1578 bp, Homo sapiens
cttttgaggtagagtcagagtagggaaaacaactaatctgttttccaaacaggttttcataaataactgacaggagatgggctgtttttatggaagtattaacccaaatgatgggtgttaatcattaaacctttttggtggtggctcgcttgtttctctgatattctaatccgggtcacagaatggctaaggcagatttaagtgcagcgtggattttttttttctcactttgccttgtgttttccaccctgaaagaatgttgtggctgctcttttttctggtgactgccattcatgctgaactctgtcaaccaggtgcagaaaatgcttttaaagtgagacttagtatcagaacagctctgggagataaagcatatgcctgggataccaatgaagaatacctcttcaaagcgatggtagctttctccatgagaaaagttcccaacagagaagcaacagaaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtagaagaaagaacaaagaaccatctgaagtggatgacgctgaagataagtgtgaaaacatgatcacaattgaaaatggcatcccctctgatcccctggacatgaagggagggcatattaatgatgccttcatgacagaggatgagaggctcacccctctctgaagggctgttgttctgcttcctcaagaaattaaacatttgtttctgtgtgactgctgagcatcctgaaataccaagagcagatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatcaggcatatgtatatattttcacacttcaaagacctaaggaaaaataaattttccagtggagaatacatataatatggtgtagaaatcattgaaaatggatcctttttgacgatcacttatatcactctgtatatgactaagtaaacaaaagtgagaagtaattattgtaaatggatggataaaaatggaattactcatatacagggtggaattttatcctgttatcacaccaacagttgattatatattttctgaatatcagcccctaataggacaattctatttgttgaccatttctacaatttgtaaaagtccaatctgtgctaacttaataaagtaataatcatctctttttgattgtg

SEQ ID NO: 32384 - DNA, 4594 bp, Homo sapiens
cccgtcacaggacagatgatcagggtgcgtccgccttttcgttcccgcttctatcctcctcccctttcccctccccatgtccctccttcttctccctcctccctctctccctccctctggcgtctccagccgactttcgcttcccgtcagcagcctttggcggaagagtgtcccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgatggcgatgaactataacgcgaaggatgaagtggacggtgggcccccgtgtgctccggggggcaccgcgaagactcggagaccggataacacggccttcaaacagcaacggctgccagcttggcagcccatccttacggctggcacggtgctacctattttcttcatcatcggtctcatcttcattcccatcggcattggcatttttgtcacctccaacaacatccgcgagatcgagattgattataccggaacagagccttccagtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacaattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaagtgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctaattaaattatggggattttggagtatgtacatgataaattataatatgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaactggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcgtatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaattttgctatgttcaggtgtcttgataaaataacaatgctccagtgttgttgcttacatttagcactaaattttaacacagcgtcagtgagtccaggttttaacttcttcatgcctggatgggataaaatgtaattcattgttaaattaattcatatttgtatttattaatcactgtgacaacattaaccatttgttcttaccaggaagtggtcagattatcatctgagttacagttagactggctaagtttggtattagatcaaggggaatgtccagtaaacagagaggtaagcatgatggaaataatgaagtggggtacacaggaaaaacctgactagtgaggaggagcagctgagagatagggtcagtgaatgcggttcagcctgctacctctcctgtcttcatagaaccattgccttagaattattgtatgacacattttttgttggttaagctgtaaggttttgttctttgtgaacatgggtattttgaggggagggtggagggagtagggaagtggtccttttacaagaattttgatgcataagtgtctattgtagggtttggatgatctagtaaagtgttttagaacccctttttatcccatgcaccattcagtaaacataaaaatcacaattctgctaatgtcatttggaacttcaaaataaatatcttgtctaaaaacaaa

SEQ ID NO: 32385 - DNA, 3775 bp, Homo sapiens
acactggctaccatgggtttatggagaggaagaacccatctctccctttggtttctgaagtgggaggtggagccctgcatccttccaaaactcacaatggacagttccacaaaacttggaaacaattccagcaattgccagggtaattgtatttttaaaatgagatgatgtgtgttagataatcagtgccatgaagaaaagtcagcatagagacagaggacctctcagaaacgcagtctttactttctgcagaaagggcgctccttgaagatggaacaatggtgagagcacacttgaacaaaggaaaagcaacatatttatcccttatgcatttggatcatccttactgtcgtatcctgcatccattggctggagctggacctcacagttttaaactgatacccgatttgctaataacctaaaactttcctaaatagattgattataccggaacagagccttccagtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacaattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaagtgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctaattaaattatggggattttggagtatgtacatgataaattataatatgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaactggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcgtatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaa

SEQ ID NO: 32386 - DNA, 2791 bp, Homo sapiens
cagggtgcgtccgccttttcgttcccgcttctatcctcctcccctttcccctccccatgtccctccttcttctccctcctccctctctccctccctctggcgtctccagccgactttcgcttcccgtcagcagcctttggcggaagagtgtcccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgatggcgatgaactataacgcgaaggatgaagtggacggtgggcccccgtgtgctccggggggcaccgcgaagactcggagaccggataacacggccttcaaacagcaacggctgccagcttggcagcccatccttacggctggcacggtgctacctattttcttcatcatcggtctcatcttcattcccatcggcattggcatttttgtcacctccaacaacatccgcgagatcgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacaattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaagtgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctaattaaattatggggattttggagtatgtacatgataaattataatatgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaa

SEQ ID NO: 32387 - DNA, 445 bp, Homo sapiens
agttgactggctgacctcgcgccgtccaccacccccttccctctgtttctctgttttttctttctctttctgcgggtttcctgaatttgcagattgattataccggaacagagccttccagtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctat

SEQ ID NO: 32388 - DNA, 4207 bp, Homo sapiens
atggcgatgaactataccgcgaagactcggagaccggataacacggccttcaaacagcaacggctgccagcttggcagcccatccttacggctggcacggtgctacctattttcttcatcatcggtctcatcttcattcccatcggcattggcatttttgtcacctccaacaacatccgcgagatcgagattgattataccggaacagagccttccagtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacaattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaagtgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctaattaaattatggggattttggagtatgtacatgataaattataatatgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaactggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcgtatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaattttgctatgttcaggtgtcttgataaaataacaatgctccagtgttgttgcttacatttagcactaaattttaacacagcgtcagtgagtccaggttttaacttcttcatgcctggatgggataaaatgtaattcattgttaaattaattcatatttgtatttattaatcactgtgacaacattaaccatttgttcttaccaggaagtggtcagattatcatctgagttacagttagactggctaagtttggtattagatcaaggggaatgtccagtaaacagagaggtaagcatgatggaaataatgaagtggggtacacaggaaaaacctgactagtgaggaggagcagctgagagatagggtcagtgaatgcggttcagcctgctacctctcctgtcttcatagaaccattgccttagaattattgtatgacacattttttgttggttaagctgtaaggttttgttctttgtgaacatgggtattttgaggggagggtggagggagtagggaagtggtccttttacaagaattttgatgcataagtgtctattgtagggtttggatgatctagtaaagtgttttagaacccctttttatcccatgcaccattcagtaaacataaaaatcacaattctgctaatgtcatttggaacttcaaaataaatatcttgtct

SEQ ID NO: 32389 - DNA, 3026 bp, Homo sapiens
agcagtccccgggcttgcgcggcgcggagagggaggcgccccgcggcggggcccccactcggtcagcccgcgcgtcggtccccgcgcggccgccatgacctggagcgccacggcccggggcgcccaccagcccgacaacaccgccttcactcagcagcgcctccccgcctggcagccgctgctgtcggccagcatcgcgctgccgctcttcttctgcgcgggcctggccttcatcggcctgggcctgggcctctactactcctccaacggcatcaaggagctggagtacgactatacaggcgacccgggcaccggtaactgctcggtgtgcgccgcggctggccagggccgggcgctgccgcccccctgctcgtgcgcctggtacttctcgctgcccgagctcttccagggcccagtgtacctctactacgagctgaccaacttctaccagaacaaccggcgctacggcgtgtcccgcgacgacgcgcagctgagcggactccccagcgcgctgcgccaccctgtcaacgagtgcgccccctaccagcgcagcgcggccggcctgcccatcgcgccctgcggcgccatcgccaacagcctcttcaacgactccttctcgctttggcaccagcgccagcccggcgggccctacgtcgaggtgccgctcgaccgctccggcatcgcctggtggaccgactaccacgtcaagttccgcaacccgccgctggtcaacggcagcctggcgttggccttccagggcacggcgcccccgcccaactggcgccggccagtctacgagctcagccccgaccccaacaacaccggcttcatcaatcaggacttcgtggtgtggatgcgcacggcggcgctgcccacgttccgcaaactgtacgcgcgcatccgccagggcaactactcggccgggctgccgcggggcgcctaccgcgtcaacatcacctacaactacccggtgcgcgcgttcggcggccacaagctcctcatcttcagcagcatctcgtggatgggtggcaagaaccccttcctgggcatcgcctacctggtcgtcggctccctctgcatcctcaccggctttgtcatgctggtcgtctacattcgctaccaggaccaggacgacgacgacgaggagtgattccggctttccagggatccctcctgcttcttgccaaaactcttgcaaggtgcttttggcatctcctcctcgcccgtcacccaattccaacctcgcctagcttttcctccctttgtgaatgaggggaccagataagggaattaccccccttgctcttggggggctgctagactgtcttgccgcggggagggatgttgactgcagagtgaaacatccttgcaaactcttcccacctccttcacgacactgagttgccatgtgaggttcttcaagtctgagagtggaagggatccctatggagactcctattaaacccctattagaggaagagattgagagacctagcaatgtgaagtaacaaagatcaggcagctgcaagtgactcctgaatcttgagtccagggctttcgccactacagtacagtggttttcttttctttggtcggggagagtgggctggaatggagagtgaggcccacaaattacctgcagagacgtggaggcgtgagggagaacatgcttgttaaatatgcaggtagattaggagacaccaaacagagattcagacacagtaaggctgggatgagatcctcgaagctgtgttttaacaaactccactggagagtcccatattccctcaaatttgggaatcacgaccctgaaccaggttgggcctgaagcagtcaactgaattcactttttcggatagtaatttgttcccaggggcagtgacaaccatgatgttccaggtttggtctggcactctgccttgaacgtaggaagctcttgattttattgattaacatcaatcagtatgtttaaagttattctaagaagcaatagtttatttttaaaaaccttgtatagcaaaataacttaaaaccctttgtgatatcatcttaccagtttatttggtaaaaacaaacagttatttggtatttgtcagaattcttcagtgcctgctattacagctattttccaattactaacttgattatactcactcaaggcagtgcaagatcttgaagtactttttagcagttaagtaatattgaattgtattgaatagtttacatagtttattctagtctttgaaaattactgaacatggacaatgtgcatgtcattgacatctgccttagaacttctgggacaatcctgattcgagagattctatcccattatttacatataccaaaaatactttgttaatttaatgtgttggcttcccaactcctgaacacgacacaattttattattagattttgtatggtgattttaggctatgaaaacatgatcattatatgtatatagatacatttttatttgttacaaatgtttgagcagctcactagcccacccctcctctattttgggtaagagaatttactaccttttttaactatgtagttgagagcaacatgtattttgttatttttagaatggtcagtatattgctataaaattttaaatgagactatgaaagttaaagtattctgattctggttaaattaacgaatatggttccaggccctgttctctgggtttttgagagagaataaaggttatgtttgtcttacctttgttatcgagtttgctgaattcttttgaacgatgatcttaaaggcacaaacaccaccagccactttgctaatttcttaatagcagatttacattgcagcaagaaaaccatcttttatagtaacattcagttaaaatgaactcaattcattgttaacttcctaaaacagaatttgaactttatcaacctcaacgtgtatataaactagatagtcctcaatactttatcaacctcaacatgtatataaactagatagtcctcaaatactgtttgaatttaataaatgtcaattt

SEQ ID NO: 32390 - DNA, 4471 bp, Homo sapiens
aaacagatttatcataacgtaattccctggacactcccaacttgagactgaaagctgggcgaaagcggtttgtgaagctaacctaaaagacaaaatggtctagagccaccttttccccgcaaataacagaggattaaggatctgaaatcttcaagcctccaggaccacggtgcaagccctcagcaaaaatttctgctggaggccggagcgccttttgatttcgggagactggcccaggaactctagtcacttggaaggcggaagagaaggtggtacctgagccaggtaggagccactcagaggcagcccggggccgccactcacctaggagaggaggtggagtccgatgacctggactgagaggaaacgcgagactgagtctaccaggtgaggtaaaaaacacccacctgctcacctcggaaggggcgggcgaggtgcggctcccggtgacccgcgggggtgcagcgcacctgggcggaggcggaactgggagggtgtgggcactgctcgtagggcctggaactaaactcacctgtgacggaggcagaggaggggcccgggcaaaaacccacctgagctggcgggaaacccgacccgcgagcagtccccgggcttgcgcggcgcggagagggaggcgccccgcggcggggcccccactcggtcagcccgcgcgtcggtccccgcgcggccgccatgacctggagcgccacggcccggggcgcccaccagcccgacaacaccgccttcactcagcagcgcctccccgcctggcagccgctgctgtcggccagcatcgcgctgccgctcttcttctgcgcgggcctggccttcatcggcctgggcctgggcctctactactcctccaacggcatcaaggagctggagtacgactatacaggcgacccgggcaccggtaactgctcggtgtgcgccgcggctggccagggccgggcgctgccgcccccctgctcgtgcgcctggtacttctcgctgcccgagctcttccagggcccagtgtacctctactacgagctgaccaacttctaccagaacaaccggcgctacggcgtgtcccgcgacgacgcgcagctgagcggactccccagcgcgctgcgccaccctgtcaacgagtgcgccccctaccagcgcagcgcggccggcctgcccatcgcgccctgcggcgccatcgccaacagcctcttcaacgactccttctcgctttggcaccagcgccagcccggcgggccctacgtcgaggtgccgctcgaccgctccggcatcgcctggtggaccgactaccacgtcaagttccgcaacccgccgctggtcaacggcagcctggcgttggccttccagggcacggcgcccccgcccaactggcgccggccagtctacgagctcagccccgaccccaacaacaccggcttcatcaatcaggacttcgtggtgtggatgcgcacggcggcgctgcccacgttccgcaaactgtacgcgcgcatccgccagggcaactactcggccgggctgccgcggggcgcctaccgcgtcaacatcacctacaactacccggtgcgcgcgttcggcggccacaagctcctcatcttcagcagcatctcgtggatgggtggcaagaaccccttcctgggcatcgcctacctggtcgtcggctccctctgcatcctcaccggctttgtcatgctggtcgtctacattcgctaccaggaccaggacgacgacgacgaggagtgattccggctttccagggatccctcctgcttcttgccaaaactcttgcaaggtgcttttggcatctcctcctcgcccgtcacccaattccaacctcgcctagcttttcctccctttgtgaatgaggggaccagataagggaattaccccccttgctcttggggggctgctagactgtcttgccgcggggagggatgttgactgcagagtgaaacatccttgcaaactcttcccacctccttcacgacactgagttgccatgtgaggttcttcaagtctgagagtggaagggatccctatggagactcctattaaacccctattagaggaagagattgagagacctagcaatgtgaagtaacaaagatcaggcagctgcaagtgactcctgaatcttgagtccagggctttcgccactacagtacagtggttttcttttctttggtcggggagagtgggctggaatggagagtgaggcccacaaattacctgcagagacgtggaggcgtgagggagaacatgcttgttaaatatgcaggtagattaggagacaccaaacagagattcagacacagtaaggctgggatgagatcctcgaagctgtgttttaacaaactccactggagagtcccatattccctcaaatttgggaatcacgaccctgaaccaggttgggcctgaagcagtcaactgaattcactttttcggatagtaatttgttcccaggggcagtgacaaccatgatgttccaggtttggtctggcactctgccttgaacgtaggaagctcttgatgatttgtggaatgaatttttaaaaaattactatctggggaaaactagttggcatacagagttgtaggacagggtttatgtgattcatttgatattttagtattttggtgtaaaagccaacaggcaaactttgccaggtactgtgtagaaactcgaaaatgtgaggccagtttgtacagttcagaggaaatgctttaacgtagaatcagatagctggaagagatcttcgagggaaagtaagttccctaaagtcacatctatgtctcctagctcagtgttctttgtcattgtgtgtgtgtgtgtgtgtgtgtgtgtgtgtgtgtgtgattagaaagggcttcattcataccttttcccttggacctggaaaaaaaattttttttatcttttcaaatgaaatctattgatttctagtaatcatatttgaatcaatgttaaagcatatatagtcttatatgtaaactagattcttaagattatttgaacctttgagatgaagtttacactcaactaaaatcattccattgattttattgattaacatcaatcagtatgtttaaagttattctaagaagcaatagtttatttttaaaaaccttgtatagcaaaataacttaaaaccctttgtgatatcatcttaccagtttatttggtaaaaacaaacagttatttggtatttgtcagaattcttcagtgcctgctattacagctattttccaattactaacttgattatactcactcaaggcagtgcaagatcttgaagtactttttagcagttaagtaatattgaattgtattgaatagtttacatagtttattctagtctttgaaaattactgaacatggacaatgtgcatgtcattgacatctgccttagaacttctgggacaatcctgattcgagagattctatcccattatttacatataccaaaaatactttgttaatttaatgtgttggcttcccaactcctgaacacgacacaattttattattagattttgtatggtgattttaggctatgaaaacatgatcattatatgtatatagatacatttttatttgttacaaatgtttgagcagctcactagcccacccctcctctattttgggtaagagaatttactaccttttttaactatgtagttgagagcaacatgtattttgttatttttagaatggtcagtatattgctataaaattttaaatgagactatgaaagttaaagtattctgattctggttaaattaacgaatatggttccaggccctgttctctgggtttttgagagagaataaaggttatgtttgtcttacctttgttatcgagtttgctgaattcttttgaacgatgatcttaaaggcacaaacaccaccagccactttgctaatttcttaatagcagatttacattgcagcaagaaaaccatcttttatagtaacattcagttaaaatgaactcaattcattgttaacttcctaaaacagaatttgaactttatcaacctcaacgtgtatataaactagatagtcctcaatactttatcaacctcaacatgtatataaactagatagtcctcaaatactgtttgaatttaataaatgtcaatttaaaaatttttgtagtagtcttctgcattttacttcaattataaattgcaattatttattggatattttggacttcaaagcagcagaaactttaaaactgaaatgggaaacgttttcctgcaatgatccctgtgctgtaacattttgtctggtgtctcaggcttccaggttcttgttggcctgaattcccttgttgcccagtaaatgttcactagctagaagtatcttcaggaagtgagatagaaaagagtgaacctcaacaattggactggaaatgagctttgacctaactttgtaaaataaaagcataaaagagaaa

SEQ ID NO: 32391 - DNA, 444 bp, Homo sapiens
atggaggagagagcacagcactgcctgtccagattactagacaactctgccctgaagcagcaggagttacccatccaccggctatatttcacggccaggagagtcctctttgtctttttcgcaacaggaatattctgcctttgtatgggcatcatccttatattgtctgcaaggagcactcaggaaatagagattaattacacaagaatatgtgcaaattgtgcaaaactgcgagaaaatgcctctaattttgacaaggaatgcacctgctctattcccttttacctttcaggaaaaatgatggtaggtgaaattcaagaaactcggttgactttacactgatctattcctatgtaacacttagcagtaagttcacaatttccatgaaatgctttccaaaactgaaaatatgaaacataaagcaggatggtggtggtgaatccg

SEQ ID NO: 32392 - DNA, 454 bp, Homo sapiens
cctttgtatgggcatcatccttatattgtctgcaaggagcactcaggaaatagagattaattacacaagaatatgtgcaaattgtgcaaaactgcgagaaaatgcctctaattttgacaaggaatgcacctgctctattcccttttacctttcaggaaaaatgatggtaggtgaaattcaagaaactcggttgactttacactgatctattcctatgtaacacttagcagtaagttcacaatttccatgaaatgctttccaaaactgaaaatatgaaacataaagcaggatggtggtggtgaatccgaaagattgttgagttcatatcccctccctcctttttgagtattattctcctcctttgtttctaagttgcaagattctttacctatccaactttgtaacataaatcttatctaccaaacaggttttactctaaatatcagcacaggga

SEQ ID NO: 32393 - DNA, 3341 bp, Homo sapiens
tttgcagtgcgcaggcgcatcaatgaggtactgcaatgtcccggaccgtatagtttccaggacgtctcgccgcgcgcatgcgcagaaacactgggcacagggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgaagaaggagacgaggtattcctacaacactgaatggaggtcagaaatcatcaacagcaaaaacttcgaccgagagattggccacaaaaaccccagtgccatggcagtggagtcattcatggcaacagccccctttgtccaaattggcaggtttttcctctcgtcaggcctcatcgacaaagtcgacaacttcaagtccctgagcctatccaagctggaggaccctcatgtggacatcattcgccgtggagactttttctaccacagcgaaaatcccaagtatccagaggtgggagacttgcgtgtctccttttcctatgctggactgagcggcgatgaccctgacctgggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcactccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgttagtcattactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcagaatctttgtagtgtgtgggatctctgaaggccctatttaagtttttcttcgttactttgctgcttcatgtgtactttcctaccccaagaggaagttttctgaaataagatttaaaaacaaaacaaaaaaaacacttaatatttcagactgttacaggaaacaccctttagtctgtcagttgaattcagagcactgaaaggtgttaaattggggtatgtggtttgattgataaaaagttacctctcagtattttgtgtcactgagaagctttacaatggatgcttttgaaacaagtatcagcaaaaggatttgttttcactctgggaggagagggtggagaaagcacttgctttcatcctctggcatcggaaactcccctatgcacttgaagatggtttaaaagattaaagaaacgattaagagaaaaggttggaagctttatactaaatgggctccttcatggtgacgccccgtcaaccacaatcaagaactgaggcctgaggctggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggatgtcttaaatgattctttgtgtaccttttctgtcatattcagaaaccgttttgtgcctgctgggagtaattcctttagcaattaagtatttggtagctgaataaggggtcagaacttctgaaaccagagatctgtaatcatctctattggcctggggtgcctgtgctataaatgagtttcttcacatgaaaaacacagccagcccaagatgacttatctgggtttaggattcaatagtattcactaactgcttattacatgagcaatttcatcaaatctccaaactcttaaaggatgctttcggaaaacacgctgtatacctagatgatgactaaatgcaaaatccttgggctttggtttttttctagtaaggattttaaataactgccgacttcaaaagtgttcttaaaacgaaagataatgttaagaaaaatttgaaagctttggaaaaccaaatttgtaatatcattgtattttttattaaaagttttgtaataaatttctaaattat

SEQ ID NO: 32394 - DNA, 4054 bp, Homo sapiens
ggcagagcgcggcgcggggccggcggcgaaggtccggggtggaatcgacgtcgctgcggctgccgacgacccacacccggccggccgcctccgcagacccaccttggccgcgcggcagggggcgcgcagagccccgagggagcgagtccccgcgcgtggcagctcggcggcttctcccttcgggaggtccggctcccggctctccggacccgcctggcgtcctcgcctgcggcggggcggacgacagcggcgcccaggaatggcttcggcgggcagcggcatggaggaggtgcgcgtgtcggtgctgacccccttgaagctggtcgggctggtgtgcatcttcctggcgctgtgtctggacctgggggcggtgctgagcccggcctgggtcacagctgaccaccagtactacctgtcgttgtgggagtcctgccggaaacccgccagcttggacatctggcactgcgagtccacgctcagcagcgattggcagattgctactctggctttactcctgggcggcgctgccatcattctcattgcattcctggtgggtttgatttctatctgcgtgggatctcgaaggcgtttctatagacctgttgcggtcatgctttttgcagcagttgttttacaggtttgcagcctggtcctttacccaatcaagttcattgaaactgtgagcttgaaaatttaccatgagttcaactggggttatggcctggcctggggtgcaactatattttcgtttgggggtgccatcctttattgcctgaaccctaagaactatgaagactactactagaaccaatagtctcaaagtaaaaacaaccaccaccatccaacaaaaggattacgtctgcatcttttctaacttactattttctaaaacacttgtggagcatcaagcagtttgctcagttgatttaatcttttttgccttttggctgtcaacatcataaccagcttttacatccattttagaaatctgcacaaattaagagagctgattagacataggcaaatgctgcaaacttccaatatgttcatatcgtttttcttgacaaatgaagggtctatatgacagcaaccattgtgagaaactagttggaatgagatttgcctcaatctcctattgcctgcaggggagcagttggcataagcaacatttagaagttcctttgcgctgacaaggattccactgttagagcccttaccgcctgcttatcctacccaatgactacattggctgttggttatttgcttgagtgagcccttgaaaaatgaactgcccttcagcatctaatgggagttgtgaatgtaactggttaatgatacacattccaccttcaggaacactctttttaatgggaggttatgctttggcaatcagcgtctccctgggaagagagtcaagacttggagacatgtgcttctcattatgtggttagaaattggtgcctcagccctatctagactggggaaaaattgaggatctctgtttttcctggggcaaacagaaagaaatctgcatgagttgcttttgtaccctttaaatcatttgccaaacattgcagcaaacaagtgtgcgtatgtaacaagcttcactgtttttatagaaggtgaaccattagtataaatggtaataagttgttccctaaccctccacatacatttgcctatcacacgtaaaattaatatttactctagtgaagtggtttgagcactaaccttgtacacattgttaagaggcttagattggtattcatacttatttaccatacaaaagtatggtaccttaaagcttttgctctatgttctttactgtttcactggaaagtgtcaatagagttgcctaagaataaaaattgaaatggtgttaatctgaaaattaatgattctctgtaagcactgtagttgaaaagagagtagcaattaggatgatcattttgtgtaaaattcattaaaatagaaggctgctattttttgcaagtattttaaatgtcttcatttttttaagaaaggaatagcgatagatttatataaatatctaaatgtctcagtagaggagtagaattcatctggttatcacctggtcctctgaagttaactgatgggctaaccgatttgtgcacacacttaggatggatttatgttaagggaattacttactgactgttcaatggaaggaagtattaataatagggaataagtttgcaactaatctcatgctgcaaacttgtgttaattctgtttaatatacaaatttggatagcttaattataaacatatttttatatcaaatatacagttctaatataaaagttataaataattatttttgttaacaaagacactaaaacagtatgttctggttttggccctcttgcagaaagaagcattagaaaaattactttaaaagtagctatatgttactgtattgcaaaatctgttaagagcaggaccacatcgatagtatttaataatttgttttacctcccaaaacacagttcttctttcagcttgtcttaagaatggttgccaaaaacaacagccaaaaaaaaaaaacctattttattatccaaatgctagaaaacacacatgaattttctataaaatcacgaatatgaagtaccaggtttagtcttactttagcaatgatagacaaaagcgaataaatacatcacagacagaaacctttataaaaatatatgattctataaagaatcattagaaattatgagtggaaattctccagaaagatagtattatagagtcttttgaagcaattttttgagaaatagtaaaatctggggcagagtgtcttgcagttaattgcatattgtcagagcagcatgagaaatatgatatttggatagggatttcagcaactaaacattctctgttctgagatctctttattcctgaataatgaaagaatagtactttggtgctgacaccaatgaggcacttctcttggtcctagtagaggatgcagtgtactgttaaaccaatatcatcacatctcgagtcttatcaagttttcattctctgtcaatatgacaagctcaaagtgacagaatatgttataggttgaagcacacatatttgcagtttactgaaaagtagatttcttatgtgacttttttcccttctcagcaaagagccctacactagatttctaccatcactaatatttggaagtatttcattactaacaatctcagtacaacatgaaaattgttgcttctcatctaaaatacaattttgtctatcagaataaacacaagtgaaattttcacctacattaacattatgtctttgcagctttaggtttgttagatgtgttcttaagcataatttttagccacaaacccattgttagatagatatctatggatatagatctacatctatagatatagatatacacacatatatatactcacacacatatagcataaaatactcagcagggctagttattccgatttcttgcacaattatttagctttttgtaagttcaacatgtaaattttaaagacataaatatagagagacttatgtgtttgaatataaatgatatatatggattagcatgtacctgtatattattaaacatgcaatgaactgactggtaagtgacgtctaattgtatggctagcaatgtaatttattcagactgtatttttgtacagagcagtgcactctaacctatgcctctgtgtcctctttaatgcctaaagctgtgcctagaaatttcatctgtcttaaaagtaaaatatacttcatgctgtttatgctattagtttctgtactgctattctatatttattatttttaaatatatgacatgtttactacttaaacatgaattcatggtatcctggttattttttttaagtcatctgggggaaaacctgtttatcactccagtgattttgagtttgcagtttcacaatcagttcttcatttcatgatttttgtagttgacatgaagtcatctatgtggaaaaaaataaaaataaaagtgatttcacggatgtggtttgaa

SEQ ID NO: 32395 - DNA, 2019 bp, Homo sapiens
ctcctgtacgccctagactaggggccgccatctccatggccacggccgtgagccggccctgcgccggcaggtcgcgggacatactgtggcgcattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacagcaatacaagttcttgcgttttaggagatctctgctcttattagttaaacacagttgtgtggaatcactgttcctggttagaaatttctgcattttatattattttcttggctatattcccaaagcttggattagcactgctatgaaccttcacatagatgagcaggttcataggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccaggtggacatccccacaattggacagccatttcaagggagtgtttgaatcttttaaatggtatgactcagaaactgattctctatcaagaagctgctgctacgaatgggagagtgtcttcatcttacccagtggaacctaagaaattaaattctccagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctgatcagcaaatgactgaattttctaatccttctccatctacctctattagtgctgagggtaagacaatgagacaacccagtgtgatttattcatggattcagaataaacgtgaacagattaagaatttcttgtcaaaacgggtgctgataatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcag

SEQ ID NO: 32396 - DNA, 4472 bp, Homo sapiens
ctgcttctggcgccccgctggaccctgcttcgaagggaccgtttggtcgccagagggcggttcctggagttacagccgcgtttgcgggacgtgtctgcgcggcagtcctggcctgttgagcttgtccagacgaagcctcgcagggatgggttggagcctgggccgggcttcgctcaggcagcgtttgaggcagacccagcagggtcctcctggggccttcctgcctttgaactgcggtggcgggcgggcgcacggtctcctgtacgccctagactaggggccgccatctccatggccacggccgtgagccggccctgcgccggcaggtcgcgggacatactgtggcgcgttttgggctggaggatagttgcaagtattgtttggtcagtgctatttctacccatctgcaccacagtatttataattttcagcaggattgatttgtttcatcctatacagtggctgtctgattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacagcaatacaagttcttgcgttttaggagatctctgctcttattagttaaacacagttgtgtggaatcactgttcctggttagaaatttctgcattttatattattttcttggctatattcccaaagcttggattagcactgctatgaaccttcacatagatgagcaggttcataggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccaggtggacatccccacaattggacagccatttcaagggagtgtttgaatcttttaaatgaaatgactgaattttctaatccttctccatctacctctattagtgctgagggtaagacaatgagacaacccagtgtgatttattcatggattcagaataaacgtgaacagattaagaatttcttgtcaaaacgggtgctgataatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttacagaagcattgatggcagtcgaaatgtctctagctcatataacttaatagtaataactaaaaaacttttagaatttacttttgaaaggagggaagccagttctgaaatgagtataggttgatttcatagtcttcttaattaagagtttagctctttgtaaactcaaaatacataaactttttaagtgtagtttcatttactgaaggataaaaatggtaacagtgcagcaatattcacaaaaaatattgtctaacggacatattttgttaatctgttaggttgggtttttgtttccagggacaaattaaatttgtatgattacccaaaaaagggtctcagtttacagatgctaactctatataaaggaatgtggaaaaactcagttcttaagttacaagattaaaaattcacatttggtctttaagaaacaattgactgacatctatgaatttattttgtatcatgctagtaaacacgaagtattaatgtatgggtattttcccagctagttttgctttctttttctggagcaaaacattaagtgattgcagagtttttcaagcaagagaaaaaggtttgcaaaaaaacccaggaaatgttcccttttttccccaccattcatcttcattagatcaaattctgtgaaacttgtctggtctctcaaagggagcagcctctgtagtgttaaatggctaattaaaataggaagatctttatagccagaaacaacttagtcatcaaatagcaagtgaaaccaaaacgtcagagggattactgtacttggaagtatgttgtgtgtcccaaatgtgaacgaagtattgttagaatttattagatcagcttctttggagatcaaagattggaaatcctagtcatagatattcactggactggctttggactgaaatgctcctttgtaattcttttcctattgtcttttccttctagtgtcccaaaatattttctttaaagtcagcacagtactgtatatgaatctttaatgtggtatcatatatgtctacttttgtctgattcatcgatgtattatatctttataattgaatattttagctccgggtcctgttgccccttcaagcagtacatgccaaattataaataggtgctactggccttgagcatatcactgtgggacagttccccaattgtcaagtgtttagatatgtagactattgccatttgtttttttgttttggttttgctttgtgtctgaagctgaattgatttcttttttttgaatgtgaaagttgaatttcaaacgtagtcatttcttacagatggccaagacagaaaattgtggctaggttgactgagaactgttgtcttccatgtattaacacaattaagctttttatattccactctctgtgctgaccctggctgaggcattttgggagacaaggactctgaatcttctgcttccattaaagaagaactgtgatattcaacattggatttctgagaataaagataggatgattcctttgaactttgacttacttgtataaaatgtccagctaggttaggtttttgccatttcctatatactttgggtaaagctacatttgatgagcaatgtgaatgtttctgagaatgttcattcctgttttctcttaagagaatgtgctgtgtactaaatacaggccacatagtgtctgcctgttgaagatctggaaactgcctccccagatctgtattgtatttggtaggtaagggggtcagtttctttttctcattgtgtgttgataatctacacaccatctgttggaaccagggtgttattatggggaactcctcctgtgtactaggaggaggaccttagggagaccaagaggagagaagcatttcctttgatgaagtcacatcctgtctatgagcccactaatgctgtaacattggcctgaaagagagtgttctttaaaagcctttctcggctgttagtataaaaacatgatggtatcagctcttagcatgtttgcttgacccttatggaaggtataaatccacagaacttccttcccagagaactgggaaattgtcctagaaataaaccttgtacagttgagtggacatggataagcaacaatttgttactttgcaggatttgttccttggtaattgtttggtgtgtcatcctgtaaatattcatgatagtctgtttatatccttttgtatatcgttgatactggattgggtagaaaaataaattggcaatttaaaaaaatggaacagttaattg

SEQ ID NO: 32397 - DNA, 5134 bp, Homo sapiens
gcgtacctattgtggagaagaccaccacatcctttggtttcacttttaggtgacttataaagtaatagggagaaatgagggcagatcattttgctagctctaactgaagaattccagtcaatcaatactgtggctgttatcggctttataaaagactactattcccagcatgcctcaaggcacctccaggaagaccttgactcccagcattctgtactttggaactccgagtcccagaatgcaacattcctcctacttcctctcagggggccgtcgagactacagttcccagcatgcagcgccgccacctgcttctggcgccccgctggaccctgcttcgaagggaccgtttggtcgccagagggcggttcctggagttacagccgcgtttgcgggacgtgtctgcgcggcagtcctggcctgttgagcttgtccagacgaagcctcgcagggatgggttggagcctgggccgggcttcgctcaggcagcgtttgaggcagacccagcagggtcctcctggggccttcctgcctttgaactgcggtggcgggcgggcgcacggtctcctgtacgccctagactaggggccgccatctccatggccacggccgtgagccggccctgcgccggcaggtcgcgggacatactgtggcgcgttttgggctggaggatagttgcaagtattgtttggtcagtgctatttctacccatctgcaccacagtatttataattttcagcaggattgatttgtttcatcctatacagtggctgtctgattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacagcaatacaagttcttgcgttttaggagatctctgctcttattagttaaacacagttgtgtggaatcactgttcctggttagaaatttctgcattttatattattttcttggctatattcccaaagcttggattagcactgctatgaaccttcacatagatgagcaggttcataggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccaggtggacatccccacaattggacagccatttcaagggagtgtttgaatcttttaaatggtatgactcagaaactgattctctatcaagaagctgctgctacgaatgggagagtgtcttcatcttacccagtggaacctaagaaattaaattctccagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctgatcagcaaatgactgaattttctaatccttctccatctacctctattagtgctgagggtaagacaatgagacaacccagtgtgatttattcatggattcagaataaacgtgaacagattaagaatttcttgtcaaaacgggtgctgataatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttacagaagcattgatggcagtcgaaatgtctctagctcatataacttaatagtaataactaaaaaacttttagaatttacttttgaaaggagggaagccagttctgaaatgagtataggttgatttcatagtcttcttaattaagagtttagctctttgtaaactcaaaatacataaactttttaagtgtagtttcatttactgaaggataaaaatggtaacagtgcagcaatattcacaaaaaatattgtctaacggacatattttgttaatctgttaggttgggtttttgtttccagggacaaattaaatttgtatgattacccaaaaaagggtctcagtttacagatgctaactctatataaaggaatgtggaaaaactcagttcttaagttacaagattaaaaattcacatttggtctttaagaaacaattgactgacatctatgaatttattttgtatcatgctagtaaacacgaagtattaatgtatgggtattttcccagctagttttgctttctttttctggagcaaaacattaagtgattgcagagtttttcaagcaagagaaaaaggtttgcaaaaaaacccaggaaatgttcccttttttccccaccattcatcttcattagatcaaattctgtgaaacttgtctggtctctcaaagggagcagcctctgtagtgttaaatggctaattaaaataggaagatctttatagccagaaacaacttagtcatcaaatagcaagtgaaaccaaaacgtcagagggattactgtacttggaagtatgttgtgtgtcccaaatgtgaacgaagtattgttagaatttattagatcagcttctttggagatcaaagattggaaatcctagtcatagatattcactggactggctttggactgaaatgctcctttgtaattcttttcctattgtcttttccttctagtgtcccaaaatattttctttaaagtcagcacagtactgtatatgaatctttaatgtggtatcatatatgtctacttttgtctgattcatcgatgtattatatctttataattgaatattttagctccgggtcctgttgccccttcaagcagtacatgccaaattataaataggtgctactggccttgagcatatcactgtgggacagttccccaattgtcaagtgtttagatatgtagactattgccatttgtttttttgttttggttttgctttgtgtctgaagctgaattgatttcttttttttgaatgtgaaagttgaatttcaaacgtagtcatttcttacagatggccaagacagaaaattgtggctaggttgactgagaactgttgtcttccatgtattaacacaattaagctttttatattccactctctgtgctgaccctggctgaggcattttgggagacaaggactctgaatcttctgcttccattaaagaagaactgtgatattcaacattggatttctgagaataaagataggatgattcctttgaactttgacttacttgtataaaatgtccagctaggttaggtttttgccatttcctatatactttgggtaaagctacatttgatgagcaatgtgaatgtttctgagaatgttcattcctgttttctcttaagagaatgtgctgtgtactaaatacaggccacatagtgtctgcctgttgaagatctggaaactgcctccccagatctgtattgtatttggtaggtaagggggtcagtttctttttctcattgtgtgttgataatctacacaccatctgttggaaccagggtgttattatggggaactcctcctgtgtactaggaggaggaccttagggagaccaagaggagagaagcatttcctttgatgaagtcacatcctgtctatgagcccactaatgctgtaacattggcctgaaagagagtgttctttaaaagcctttctcggctgttagtataaaaacatgatggtatcagctcttagcatgtttgcttgacccttatggaaggtataaatccacagaacttccttcccagagaactgggaaattgtcctagaaataaaccttgtacagttgagtggacatggataagcaacaatttgttactttgcaggatttgttccttggtaattgtttggtgtgtcatcctgtaaatattcatgatagtctgtttatatccttttgtatatcgttgatactggattgggtagaaaaataaattggcaatttaaaaaaatggaacagttaattgaaa

SEQ ID NO: 32398 - DNA, 2107 bp, Homo sapiens
atctccatggccacggccgtgagccggccctgcgccggcaggtcgcgggacatactgtggcgcattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacagcaatacaagttcttgcgttttaggagatctctgctcttattagttaaacacagttgtgtggaatcactgttcctggttagaaatttctgcattttatattattttcttggctatattcccaaagcttggattagcactgctatgaaccttcacatagatgagctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccaggtggacatccccacaattggacagccatttcaagggagtgtttgaatcttttaaatggtatgactcagaaactgattctctatcaagaagctgctgctacgaatgggagagtgtcttcatcttacccagtggaacctaagaaattaaattctccagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctgatcagcaaatgactgaattttctaatccttctccatctacctctattagtgctgagggtaagacaatgagacaacccagtgtgatttattcatggattcagaataaacgtgaacagattaagaatttcttgtcaaaacgggtgctgataatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttacagaagcattgatggcagtcgaaatgtctctagctcatataacttaatagtaataactaaaaaacttttagaatttacttttg

SEQ ID NO: 32399 - DNA, 4713 bp, Homo sapiens
ctgcttctggcgccccgctggaccctgcttcgaagggaccgtttggtcgccagagggcggttcctggagttacagccgcgtttgcgggacgtgtctgcgcggcagtcctggcctgttgagcttgtccagacgaagcctcgcagggatgggttggagcctgggccgggcttcgctcaggcagcgtttgaggcagacccagcagggtcctcctggggccttcctgcctttgaactgcggtggcgggcgggcgcacggtctcctgtacgccctagactaggggccgccatctccatggccacggccgtgagccggccctgcgccggcaggtcgcgggacatactgtggcgcgttttgggctggaggatagttgcaagtattgtttggtcagtgctatttctacccatctgcaccacagtatttataattttcagcaggattgatttgtttcatcctatacagtggctgtctgattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacagcaatacaagttcttgcgttttaggagatctctgctcttattagttaaacacagttgtgtggaatcactgttcctggttagaaatttctgcattttatattattttcttggctatattcccaaagcttggattagcactgctatgaaccttcacatagatgagcaggttcataggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccaggtggacatccccacaattggacagccatttcaagggagtgtttgaatcttttaaatggtatgactcagaaactgattctctatcaagaagctgctgctacgaatgggagagtgtcttcatcttacccagtggaacctaagaaattaaattctccagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctgatcagcaaatgactgaattttctaatccttctccatctacctctattagtgctgaggcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttacagaagcattgatggcagtcgaaatgtctctagctcatataacttaatagtaataactaaaaaacttttagaatttacttttgaaaggagggaagccagttctgaaatgagtataggttgatttcatagtcttcttaattaagagtttagctctttgtaaactcaaaatacataaactttttaagtgtagtttcatttactgaaggataaaaatggtaacagtgcagcaatattcacaaaaaatattgtctaacggacatattttgttaatctgttaggttgggtttttgtttccagggacaaattaaatttgtatgattacccaaaaaagggtctcagtttacagatgctaactctatataaaggaatgtggaaaaactcagttcttaagttacaagattaaaaattcacatttggtctttaagaaacaattgactgacatctatgaatttattttgtatcatgctagtaaacacgaagtattaatgtatgggtattttcccagctagttttgctttctttttctggagcaaaacattaagtgattgcagagtttttcaagcaagagaaaaaggtttgcaaaaaaacccaggaaatgttcccttttttccccaccattcatcttcattagatcaaattctgtgaaacttgtctggtctctcaaagggagcagcctctgtagtgttaaatggctaattaaaataggaagatctttatagccagaaacaacttagtcatcaaatagcaagtgaaaccaaaacgtcagagggattactgtacttggaagtatgttgtgtgtcccaaatgtgaacgaagtattgttagaatttattagatcagcttctttggagatcaaagattggaaatcctagtcatagatattcactggactggctttggactgaaatgctcctttgtaattcttttcctattgtcttttccttctagtgtcccaaaatattttctttaaagtcagcacagtactgtatatgaatctttaatgtggtatcatatatgtctacttttgtctgattcatcgatgtattatatctttataattgaatattttagctccgggtcctgttgccccttcaagcagtacatgccaaattataaataggtgctactggccttgagcatatcactgtgggacagttccccaattgtcaagtgtttagatatgtagactattgccatttgtttttttgttttggttttgctttgtgtctgaagctgaattgatttcttttttttgaatgtgaaagttgaatttcaaacgtagtcatttcttacagatggccaagacagaaaattgtggctaggttgactgagaactgttgtcttccatgtattaacacaattaagctttttatattccactctctgtgctgaccctggctgaggcattttgggagacaaggactctgaatcttctgcttccattaaagaagaactgtgatattcaacattggatttctgagaataaagataggatgattcctttgaactttgacttacttgtataaaatgtccagctaggttaggtttttgccatttcctatatactttgggtaaagctacatttgatgagcaatgtgaatgtttctgagaatgttcattcctgttttctcttaagagaatgtgctgtgtactaaatacaggccacatagtgtctgcctgttgaagatctggaaactgcctccccagatctgtattgtatttggtaggtaagggggtcagtttctttttctcattgtgtgttgataatctacacaccatctgttggaaccagggtgttattatggggaactcctcctgtgtactaggaggaggaccttagggagaccaagaggagagaagcatttcctttgatgaagtcacatcctgtctatgagcccactaatgctgtaacattggcctgaaagagagtgttctttaaaagcctttctcggctgttagtataaaaacatgatggtatcagctcttagcatgtttgcttgacccttatggaaggtataaatccacagaacttccttcccagagaactgggaaattgtcctagaaataaaccttgtacagttgagtggacatggataagcaacaatttgttactttgcaggatttgttccttggtaattgtttggtgtgtcatcctgtaaatattcatgatagtctgtttatatccttttgtatatcgttgatactggattgggtagaaaaataaattggcaatttaaaaaaatggaacagttaattg

SEQ ID NO: 32400 - DNA, 1918 bp, Homo sapiens
gcgtgtccggggcggggctgtaccgggcgctgggcggaggagccttggctggggactgcctggaaacgggctgggcctgcctcggacgccgccggtgtcgcggattctctttccgcccgctccatggcggtggatgcctgactggaagcccgagtgggatgcggctgacgcggaagcggctctgctcgtttcttatcgccctgtactgcctattctccctctacgctgcctaccacgtcttcttcgggcgccgccgccaggcgccggccgggtccccgcggggcctcaggaagggggcggcccccgcgcgggagagacgcggccgagaacagtccactttggaaagtgaagaatggaatccttgggaaggagatgaaaaaaatgagcaacaacacagatttaaaactagccttcaaatattagataaatccacgaaaggaaaaacagatctcagtgtacaaatctggggcaaagctgccattggcttgtatctctgggagcatatttttgaaggcttacttgatcccagcgatgtgactgctcaatggagagaaggaaagtcaatcgtaggaagaacacagtacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttaggagtagcaacatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacactggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatctttttgagctaacatgtgatttttaaaatcattttgactactgggtgtataaatgtgtttgtgtgtgtatgtatttatagatgttctttaaggtacccttgaaaactctacattatgtatgccacataatgacatttcagtcagtggtagactacatatatgatagtggtcccataagattataatggagctgaaaaatttctatcgcctagtgatgtcatagcctagtgatgacatatgtattgcaatacatcactcacgtgtttgtggtgatactggtgtaaacaaatctattgcactgccagtcaagtaaaagtacagcaattatgtcctgtacataatatttaataatgacaataaatgactatgttactggtttatgtatttactatactatactttttacaatttgtattagttctt

SEQ ID NO: 32401 - DNA, 2970 bp, Homo sapiens
cccttttctctggctggctgggctcccgctcctccactgctgctcctcccactctgcgggttctttctttctccctcccctcccctcccccagccatgcctcccagcgcgcttcccttcccccgcctcctggtcctgcaccctcccctcccctccccccgcttcctgccttgtgacacatcccgggccctcccggaggcggcagcagcagcagctgcagcggcagcagcggcagcagaggcagcagcagtagccaccactccgccgaggccgcaaccccggctcggcctccccaggccccgccgctgccgcagtcatggctgctgatggggtggacgaacgctcgcctctgctgtcagcatcccactccggaaatgtcactcccaccgccccaccgtacttgcaagaaagcagccccagagcggagctcccacctccatatacagccattgccagtccagacgccagtggtattccagtaataaactgccgtgtgtgccaatcactaatcaatttggatggcaagcttcaccagcatgtggttaagtgcacagtttgcaatgaagctacgccaatcaaaaaccccccaacaggcaagaaatatgttagatgcccttgtaattgtcttctcatttgtaaggacacatctcggcgaataggatgcccaagacccaactgtagacggataattaaccttggcccagtaatgcttatttctgaagaacaaccagctcagcctgcattgccaatccaaccagaaggtacaagggtcgtgtgtgggcactgtggaaacacattcctgtggatggaactgaggttcaacactctggcaaaatgcccacactgcaaaaaaatctcctcagtgggtagtgcacttccacgaagacgctgctgtgcatatattaccattggaatgatatgtattttcattggagttgggttaactgttggcaccccagattttgcaaggcgatttcgagcaacctatgtttcttgggcaattgcttatctcctaggattgatctgccttatccgagcttgttattggggagccataagagtcagttatccagaacacagttttgcataagcttgtttatgattcagtaatgcaggtgagagtgtctagcagttcttggtaagctactctggacatctttaaattatttatcctaatggattccattctggtttatgtataatcgtttcaagactttgggagtcttttatgaacaaatgctcattgcactatattatatgcaaattgttttgctgctaggttttcaaaatttgaataataaagccttttcatgttcttttacatctcttatagatatttttggatttgttaccaaacattacatttactctcacccttttattatttttaaataagttatttcattacttgctgatacatgagtattcctaagtgtttataaatatttctataatagtttcacatttatatttacattttaattaaacagtatcaaaattgcttgcttaaaacctaagcaatatgcattttgcttgaactgcttactgtaactttaacctaagattatagtgaccttattcaggaaaaaaaaaaaaatttagtgtaacttcaaagacttgacattcttgtcagaggaaaaaaaatttctagatactgtttgcttgttttttgttgtttgtagaaagataaaatattttggtagtaatttaaaatacaagaacgaatatttatttgtccacagttggagatgttggataaatgtcttttctcaaagatcacaggacttttgtctttcatttttgcctttttatttaccatttataaaagatctggtctggattatggaatttaatgtttatcagctctatgtattcctttatagaggcttgaggaagtatttcacataacatgttttataatacttaaccatttatccaaagatatatttacattgggttgtgcccctttcccttagatcatggtaaatttttcttattgaggtaattatgtactacttatatttgaaggaagcttatgacattttacagtagctaaaatgttgagattagaggtacttttactattcttctcaaaggtaactgatcagataattacccaaattattcaagaaaatagatcagaaataaagaacaacataattttctaagaattcattgaaatttatggaatcagctctcgcactgcccatctttgcagttttgaaaaagaaattgcttaatcacaaatgttctacagtctttaaatgtagtagaattagacagtgagatcatctgagtaaattgattggtgattccagagataagactaatattttaaattatttatgatactgattagtataaaaacgtactcatcacagaatttgaagcaaaatacatgtacacttcaaagagtaaatgacaaatgtataaatgctgtagctcaggattatatgtacctttaaaaatacactaataaagattattgttcaaaaattaccttgttttattccattaaaaataatgtcacttccagagttgccttgaaatcttgctgtaaagttttcatgtttaggaatgtacctgtttctttatataatattcatttatgttttttgtactattttcaaatggttttatttttaaaatatagtttttaaatccatttgtaatacacttgatgttaggtataaaataatcttacttcttttcctaatggttaactagttgtaacagcattgtatactgaataatccattctttccctcattgattggaaagctcacattaaattatatgctatgtcatattccttctggaataataactttatgagagcaagaaccctggtagtcttgttcacagctttatccccacttagaacagttcttagtgtacatgtgctcaatttacgtgaatgaatatgcatgaatgaataaatggttgaatgaattgctattttaaattctta

SEQ ID NO: 32402 - DNA, 3255 bp, Homo sapiens
aggctgtgaggcttccagcgtcggcccagaccttctctttccctttccagcagccggagaagtgcgacaacaaccagtactttgatatctccgccctctcgtgtgttccttgtggagctaaccagaggcaagatgcccgaggtgttacagaagatggctggaactgcatttcttgccctagtgacttaactgccgaaggaaaatgtcactgtcccattggccatattttaggctggtcttgaacttccgacctcaggtgatctgcctgcctcagcctcccaaagtgctgggatacaggcttgagccaccgcacctgaccttggcatgtactttagaaggaatgtacaacataattgaagaaattttggaaagagacattaatggaacattgttgtctcaagcaacttgtgagctctgtgatggaaatgaaaactcttttatggtagtaaatgctttaggagacaggtgcgtccgatgtgagccaacatttgttaataccagcaggtcctgtgcatgttcagaacctaacattttaacagggggattatgtttcagcagcacagggaattttcctctacgtagaatttcagctgcacgttatggagaagttggcatgtctttaacttcagaatggtttgcaaagtatttgcaatcatcagcagctgcatgttgggtatatgccaatctaacatcttgtcaagctcttggaaatatgtgtgtgatgaacatgaattcttacgactttgccacatttgatgcatgtggactatttcagtttatctttgaaaatactgctggactgagcactgttcattctatttcattttggagacagaatcttccttggctgttttatggagaccagttaggattagcacctcaagtgctcagttctacctctcttcctacaaatttcagttttaaaggagaaaaccagaatacaaaactgaagtttgttgctgcttcctatgatataagaggaaattttctcaagtggcaaactttagaaggaggtgttttacagctttgtccagacacagagacaaggctaaatgctgcttattcatttggaacaacctaccaacaaaattgtgagattcctatctctaagatcttaattgactttcccactcctatattttatgatgtgtaccttgaatatactgatgaaaatcaacatcaatatattttggctgtgcctgtgttaaacctaaatcttcaacataataagatatttgtgaaccaagacagcaactctggaaagtggcttctaactcggcgcattttcttagtggatgcagtaagtggacgagaaaatgacttaggaactcagccaagagtaattcgagttgctactcaaatatcactgagtgtccaccttgtacccaacacaataaatggaaacatctaccctcccttaatcaccattgcctacagtgacattgatatcaaagatgccaacagccagtctgtgaaggtttctttctcagtcacatatgaaatggatcatggagaagcacatgtccagacagatattgctttgggtgtattgggtgggctagctgttttagcatctcttttgaagacagcaggatggaagaggcgcattgggagtcccatgattgatttacagacagttgtgaaattcttggtgtactatgctggtgatctggccaatgttttctttatcatcacagtgggaacaggtctttactggcttattttcttcaaagcacagaagtctgtgtctgttttgctgccaatgccaattcaggaagaacgttttgtcacttatgttggatgtgcctttgctctgaaggcactacaatttttgcataagctcatatcccagattacaatagatgtattctttattgattgggagcgacctaaaggaaaggttcttaaagctgttgaaggtgagggtggtgtacgaagtgccactgttcctgtaagcatatggagaacatattttgtagcaaatgaatggaatgaaattcagactgtgagaaaaattaattcactctttcaagtacttactgtcctcttctttttggaggttgtgggattcaagaacttagcattaatggactcatcttctagtctttctagaaacccacctagctacatagctccttatagctgcattttgagatatgcagtgtctgctgctctttggctagccattggaattatacaggtcgtgttctttgctgtcttttatgagagatttatagaagataaaattcgacagttcgttgatttatgctctatgagtaatatatcagtgtttctgttatcccacaaatgttttggatattacattcatggtagatcagtacatgggcatgcagatactaatatggaagaaatgaatatgaaccttaaaagagaagcggaaaatttgtgtagccagagaggtttggtacccaacacagatggtcagacttttgagattgcaatttctaaccagatgagacaacattatgacagaattcatgagacactaataaggaaaaatggtcctgctagactactgagttcatcagcaagtacttttgagcagagtataaaagcatatcatatgatgaataaatttcttggctccttcattgaccatgttcataaggaaatggattactttataaaagataagttgcttcttgaaagaattcttggaatggaattcatggaaccaatggaaaaaagcatcttttacaatgatgaaggttattctttcagcagtgtcctgtattatggaaatgaagctactcttcttatttttgatctgctgttcttctgtgttgtggatttggcttgccaaaattttattttagcatccttccttacatatctacaacaagagatttttagatatatccgtaatacagtaggacaaaagaatttggcatccaaaacattggtggatcaaagatttttgatttaacttcctgaataaataacttaaagactcagtataatcatggccaaaaaaaagtcatgatatcaggttagtttgccatattttttaaaacttataatgcagactattctgtttttgttttttatttgcagaaagatttatttttataacttgggaatatataacctgatataatagaaaatactgttttcccattgtgtgtagtatttaatgcagtaaataataaattaatactgacagtgaggccaaaaaaaatctaaatgttgctttcagcataatactttttaatgctaattaaaacagtccccatc

SEQ ID NO: 32403 - DNA, 4651 bp, Homo sapiens
aagccgccgcagaggctgatggggggctggaggctgtgaggcttccagcgtcggtaccatggcgacgcgcggtggggctggggtggcaatggcggtttggtccctcttatccgcccgggccgtgaccgcgttccttctgttgttcctccctcgcttcttacaggcccagaccttctctttccctttccagcagccggagaagtgcgacaacaaccagtactttgatatctccgccctctcgtgtgttccttgtggagctaaccagaggcaagatgcccgaggaacttcatgtgtatgtctaccaggatttcagatgatctctaataatggaggacctgctattatttgtaaaaagtgcccagaaaacatgaaaggtgttacagaagatggctggaactgcatttcttgccctagtgacttaactgccgaaggaaaatgtcactgtcccattggccatattttagtggaaagagacattaatggaacattgttgtctcaagcaacttgtgagctctgtgatggaaatgaaaactcttttatggtagtaaatgctttaggagacaggtgcgtccgatgtgagccaacatttgttaataccagcaggtcctgtgcatgttcagaacctaacattttaacagggggattatgtttcagcagcacagggaattttcctctacgtagaatttcagctgcacgttatggagaagttggcatgtctttaacttcagaatggtttgcaaagtatttgcaatcatcagcagctgcatgttgggtatatgccaatctaacatcttgtcaagctcttggaaatatgtgtgtgatgaacatgaattcttacgactttgccacatttgatgcatgtggactatttcagtttatctttgaaaatactgctggactgagcactgttcattctatttcattttggagacagaatcttccttggctgttttatggagaccagttaggattagcacctcaagtgctcagttctacctctcttcctacaaatttcagttttaaaggagaaaaccagaatacaaaactgaagtttgttgctgcttcctatgatataagaggaaattttctcaagtggcaaactttagaaggaggtgttttacagctttgtccagacacagagacaaggctaaatgctgcttattcatttggaacaacctaccaacaaaattgtgagattcctatctctaagatcttaattgactttcccactcctatattttatgatgtgtaccttgaatatactgatgaaaatcaacatcaatatattttggctgtgcctgtgttaaacctaaatcttcaacataataagatatttgtgaaccaagacagcaactctggaaagtggcttctaactcggcgcattttcttagtggatgcagtaagtggacgagaaaatgacttaggaactcagccaagagtaattcgagttgctactcaaatatcactgagtgtccaccttgtacccaacacaataaatggaaacatctaccctcccttaatcaccattgcctacagtgacattgatatcaaagatgccaacagccagtctgtgaaggtttctttctcagtcacatatgaaatggatcatggagaagcacatgtccagacagatattgctttgggtgtattgggtgggctagctgttttagcatctcttttgaagacagcaggatggaagaggcgcattgggagtcccatgattgatttacagacagttgtgaaattcttggtgtactatgctggtgatctggccaatgttttctttatcatcacagtgggaacaggtctttactggcttattttcttcaaagcacagaagtctgtgtctgttttgctgccaatgccaattcaggaagaacgttttgtcacttatgttggatgtgcctttgctctgaaggcactacaatttttgcataagctcatatcccagattacaatagatgtattctttattgattgggagcgacctaaaggaaaggttcttaaagctgttgaaggtgagggtggtgtacgaagtgccactgttcctgtaagcatatggagaacatattttgtagcaaatgaatggaatgaaattcagactgtgagaaaaattaattcactctttcaagtacttactgtcctcttctttttggaggttgtgggattcaagaacttagcattaatggactcatcttctagtctttctagaaacccacctagctacatagctccttatagctgcattttgagatatgcagtgtctgctgctctttggctagccattggaattatacaggtcgtgttctttgctgtcttttatgagagatttatagaagataaaattcgacagttcgttgatttatgctctatgagtaatatatcagtgtttctgttatcccacaaatgttttggatattacattcatggtagatcagtacatgggcatgcagatactaatatggaagaaatgaatatgaaccttaaaagagaagcggaaaatttgtgtagccagagaggtttggtacccaacacagatggtcagacttttgagattgcaatttctaaccagatgagacaacattatgacagaattcatgagacactaataaggaaaaatggtcctgctagactactgagttcatcagcaagtacttttgagcagagtataaaagcatatcatatgatgaataaatttcttggctccttcattgaccatgttcataaggaaatggattactttataaaagataagttgcttcttgaaagaattcttggaatggaattcatggaaccaatggaaaaaagcatcttttacaatgatgaaggttattctttcagcagtgtcctgtattatggaaatgaagctactcttcttatttttgatctgctgttcttctgtgttgtggatttggcttgccaaaattttattttagcatccttccttacatatctacaacaagagatttttagatatatccgtaatacagtaggacaaaagaatttggcatccaaaacattggtggatcaaagatttttgatttaacttcctgaataaataacttaaagactcagtataatcatggccaaaaaaaagtcatgatatcaggttagtttgccatattttttaaaacttataatgcagactattctgtttttgttttttatttgcagaaagatttatttttataacttgggaatatataacctgatataatagaaaatactgttttcccattgtgtgtagtatttaatgcagtaaataataaattaatactgacagtgaggccaaaaaaaatctaaatgttgctttcagcataatactttttaatgctaattaaaacagtccccatcatttgtctctgtagattattttataaactgagagctgcctgaatcttctcacattgacaaagtaatttgattccaagtttaagactagttttcagtttgatattttcatgttttgtgtgcttatggttaaataaatgttgaaagatattttcaagtttacttagaaattttaaattgtattattgctgattcaatttgcatcattctaattgctcatcctctttggcagtggattaattcactgttgggttaatatgcatctcatgaaatgatatcttttcattcctttgtatacctgtattaggtcagtatacgctttccatgaaatatatttgcatttctaatatagtttacatttattaagttataacgtatgacatttttcccaatatcattttttatacattttaattacttaatgttttaagagttctcttccagagttttgcttttcaattacgtttaaagactgtaaataacaaacagtaaggctgggcgctgtggcttacgcctgtaatcccagcactttggaaggccaaggcacgtggatcactttaggtcaggagttcaagaacagcctggccaacatggaaaaccccatctctacaaaaaatacaaaaattagttggatgtggtggcctgtaatcccagctatttgggaggctgaggcatgagaatagcttgaaaccaggaggtggaggctgtagtgagccagatagcaccactgcactccagccaggatgacagagcaagaccctgtctcagaaaaaacaaaaacaaaacactgtaaatgtatcatgtttctcactgctttctatgttaatgctgtgtaaatacttaaaatggaatactgtataaatattatttatattttctcagatgaaaatatatactaaaacatttggtatttctgttttctgtttcattaatgtatatctgatggagtaccatttaggaatataacattattggggcagaggtcccagccattgccaaagttgaatcttttacatttccctgaatcttgaggatgactgaaaaggaagtctttgaaactgcagtttctgaaggatcacagtacaggaatgcctttataaaagctgcagagataaatacatgtacttatatggcatggatatttaaaaccactcactcagaagcatatgaaagaaattcaaccatcattcaacatagaagaagttaattttagtgcaaaagtttttaagtattaaatttcacaataaaggatcaattggcttacttgctgataaattaaaacagaaaacatttaaaatca

SEQ ID NO: 32404 - DNA, 2018 bp, Homo sapiens
cgggtgggaagccgtgtctcgcagtcgtggactcgtgcagctggggcgtccgcagccgctcgtcacccgcgtgatgctgtttctggcgttgggcagcccgtgggcggtcgaactgcctctctgcggaaggaggactgcattgtgtgcggccgccgcgctccgaggtccccgggcctctgtctcccgggcgtcctccagcagcgggccttcggggccggtagccggctggagtacggggccttcgggagccgcgcgccttctccggcgtccgggtcgagcgcagatccctgtttattgggaaggatatgttcgattcttaaatacgccatctgacaaatcagaagatggaaggctaatttatactggcaatatggcccgagcagtgtttggtgtgaaatgtttctcttattctacgagtctgattggccttacatttctgccatacatttttacacaaaataatgctatttctgaaagtgtgcctctgcctattcaaatcatattctatggcatcatgggaagctttacggtgatcaccccagtgctgcttcactttattacaaaaggctatgtcattcgattgtaccatgaggccacaacagacacttataaagccattacctacaatgctatgcttgcagaaacgagtacagtgtttcaccagaatgatgtgaagattccagatgctaaacatgtatttaccacattttatgctaaaacaaaatcactgttagttaatccagtgctctttccaaaccgtgaagactatatccatctaatgggttatgacaaagaagaatttattttgtatatggaagaaaccagtgaagagaaacggcataaagatgacaaatgagcctatttgttagtgttcgtgctcaaatgtgatttacgttttaatgtataataataaaattgccttttgcattccgttagtgactgattgttaaaaataatttgaaattatcaaagcttttaatttccagagaatgatgtttgtttataataaaacaagctatgtttgaaaaccaaaatgtagtatctaccattcgtgttttagaaaggtatgtgaataaatatgttcatgctagtataagagttctgtgttactgtggttgactctaaactggggatctgatgtcagtagcaaatgggagagttgctttattctttgtgtatggatttttctaagtgtataaatattttccgacattaaaagacattttctctttgaggaagacacagtcataggtggtgcggagctgtggtccacctgctcctgctcctgactcactgctctttgctgttgcctgaggaccaagtctgtcaggaagctggctaggaagccttgcagcagccatggcttttaaacataccagaaaaacacccgtggagtcagaggtggcaattcaccgaattcatatcactctaacgagttgcaacgtaaaatccctggataaggtgtgtgctgacttgatctgaggagcaaaggaaaagaatcagtgaaaggaccagtttgaatgcctaccaagactttgagaatcactacaagaaaaacttacggtgaaggttctaaggcatgggatcgtttccagatgagaatccacaagcgactcattgacttgcgcagtcctcagatagttaagcagattacttccatcagtattgagccaggagttgagatggaagtcaccattgcaaatgcttaagtcaactgttttcataaattgattaccagttgttaaaaaattttcaaaaaaccgcaaaatttcaagaaattcacaaattatgggagcagttttaagtcttctttggttcagaacacaggtttttgcctaacccctggcatgattgcccataagaacatacatgtacagttgaactggtggttagctatacgggaaatggtaagtagtgttgtcttcagtatcttaatttgtttctgcaactgtgcactcctcccttggtggcaccctatgggtgtaggaaaaccactgttattaaacaggtgaaaaata

SEQ ID NO: 32405 - DNA, 617 bp, Homo sapiens
gtcgggtgggaagccgtgtctcgcagtcgtggactcgtgcagctggggcgtccgcagccgctcgtcacccgcgtgatgctgtttctggcgttgggcagcccgtgggcggtcgaactgcctctctgcggaaggaggactgcattgtgtgcggccgccgcgctccgaggtccccgggcctctgtctcccgggcgtcctccagcagcgggccttcggggccggtagccggctggagtacggggccttcgggagccgcgcgccttctccggcgtccgggtcgagcgcagatccctgtttattgggaaggatatgttcgattcttaaatacgccatctgacaaatcagaagatggaaggctaatttatactggcaatatggcccgagcagtgtttggtaagtaattggaggtgtgaaatgtttctcttattctacgagtctgattggccttacatttctgccatacatttttacacaaaataatgctatttctgaaagtgtgcctctgcctattcaaatcatattctatggcatcatgggaagctttacggtgatcaccccagtgctgcttcactttattacaaaaggctatgtcattcgattgtaccatgaggccacaaca

SEQ ID NO: 32406 - DNA, 1741 bp, Homo sapiens
ggcgggcgctgcccacccggcggagccgagcggcgtgcagaggctacaagtgccgtagctggtgattgggggactttctccgggaaccgtgccgggagagcgcgcggtgctggagccgcaccgggtggccgaagcagaagactttccggaagctgctgggggatgtctgactagctctcatggagctccactaccttgctaagaagagcaaccaggcagacctctgtgatgccagggactggagttcaagagggctgcctggtgaccaggcagatacagcagccacaagagctgctctctgctgtcagaaacagtgtgcatccaccccaagagcaaccgagatggaagggtctaaacttagttcttctccagcatccccctcctcctctctgcaaaacagtactcttcagccagatgcctttccaccaggacttctccactcagggaacaaccaaataacagcggaacggaaagtctgtaactgctgcagccaggaattagaaacttcttttacctatgtggacaaaaacatcaacttggagcagcggaaccggagctcgccatcagcaaaagggcataatcaccctggggagcttggctgggaaaatccaaatgagtggtcccaagaggctgccatatctttgatatctgaagaggaggatgatacaagttcagaagccacgtcttcagggaagtctatagactatggtttcatcagcgccatcttgttcttggtcactgggatcctgctcgtgatcatctcttacatcgtcccacgggaagtgactgtggaccccaacactgtggcagcccgggagatggagcgcctggagaaggagagtgcgaggctgggggctcacctggaccgctgtgtgattgcggggctctgcctcctcacgctggggggcgtcatcctgtcctgcttgttaatgatgtccatgtggaagggggagctctatcgtcgaaacagatttgcctcttccaaagagtctgcaaaactctatggttctttcaacttcaggatgaaaaccagcacgaatgaaaacactctggaactgtccttggtagaggaagatgcgcttgctgtacagagttaattctggttgtgaatatcttgagagtctgccttggcattttataatatgaaaaaagttaatttataaaaattcacagtgcaatttatttgcctggcaagaaaagtttatttcacaaaccaacagccagtaagtgtttttgttctctatgtgtcttctatttagaagaaaagccatgtaagatgtataagaaaccacaaccagccacacctatccttctgaagagctgaaggctaattaatctgtaatggccaagaacttctacttcgatagaaaaatatttctaatgacccagtctacaaattatttcttttacacaaatatatgatgttattctttggacactaggtggtcctacacacagtaggatcaattgctaatctactttgtgaaaaagaactaagcactaatcaataataaggcttacatctaattctcaaaggtgcttatccattttcttgctaaattatccttcttgtaatttggctaaacactaaaacatggaatttttagtttgaatattttgaagtttgaggatgttgggctttccttattgtaaaaaatgttatgtttgaaattattcctgttttcaaaaatggtaattaagtcattaggataaactttctaataaaaaaaaattatgtaaa

SEQ ID NO: 32407 - DNA, 2528 bp, Homo sapiens
agccctcgcgggggcaaggcggcgaccgaggcgcgtgggtctgggaaggcgcgcggatttggcccctcttctcacatcagcgggtccaggcccaaccgacagactatgggggctccggcaaccaggcgctgcgtggagtggctgctgggcctctacttcctcagccacatccccatcaccctgttcatggacctgcaggcggtgctgccgcgcgagctctacccagtcgagtttagaaacctgctgaagtggtatgctaaggagttcaaagacccactgctacaggagcccccagcctggtttaagtcctttctgttttgcgagcttgtgtttcagctgcctttctttcccattgcaacgtatgccttcctcaaaggaagctgcaagtggattcgaactcctgcaatcatctactctgttcacaccatgacaaccttaattccgatactctccacatttctgtttgaggatttctccaaagccagtggtttcaagggacaaagacctgagactttgcatgaacggttaacccttgtgtctgtctatgccccctacttactcatcccattcatacttttaattttcatgttgcggagcccctactacaagtatgaagagaaaagaaaaaaaaaatgaaggaaacaaccactggcccagggtagagatgcctacagggtggttgcttgttggatacaatacaaggaacactgctcagaacccacgtcttcagcagcatttgaaacactggcagcaatgcacaagagcaagatggtgtcaggaaccatgtcaaaccctcaccttcttccattttttttttttttttaagacagtctcactctgttgcccaggctggagtaaagggcagtggcatgatctcggctcactgcaacctccgcctcctgggctcaagccatcttccttagcctcccaagtagctagaactacaggtgtgtaccaacacgtatggctaatttgttttgttttttttgtgtgtgtggagacagggttttgccatgttgcccaggttggtctcgaacgcctaggctcaagtgatctgcccacctcagtctccctaagtgctgggattacagacgtgaaccactgggcccagcccaaaccttcaccttctaagggcactgggatgaacagaccgatcggcttgagggtgggcaaaggggtgtgggctaggttataaggaagtggtaccaaataactgtgtgcctgagttccaccgcaagattactaaaagcaggaccagaccagaaactgctaaagaacatggcctgtttgacatgttcatgagtcacctgacccacagcatatatgcttatgactaaaccctccactcctgattctcaagagtgtatcacctgtcagcaaaatgaatagtgggatattttgggccattttaaatgtgaaattttgcctctttaatgttaattcaaaactatatcaatgttttcttgttcccacctctaacccaaggaaaaaagagaaaacatactatgcaaaggaagtttaaacttaagttttccttaagggtcagcccaacaatgactttcagtcaaatggattaaactggaaaatgtttttgtttctgttgtaaacagatcatcctaggcgaaagttttttttgtttgtttgcttttaaattagtttatttctaaatcttagtcttccacatttctagaggccacctgacacaagtccctgtatctgaagtctagcatctcaaggctgatctggaagtgtgctagtatgctccctagtggataacttaatcttttaatacagttccgtcattcccatcttgttttcagaagagaaggtggctacagccaggcataacatatccactgtgtgcatagagggtctcttcacgttgatgcttggcattccatcagctttctctaagtctttgctcaagttcaaccttaaaatgatgttagacaacaggtcccagtcagttccctctattttcacccattttgctcacaagccatattggcccgattagtggtactgtctgactcacgtgtgtgatccaaataaaggtagctgctgaccactgcctggtttgttttgtggactaggggatagagaatccagggttctctcatgaggagttaaacatatttcaagagcaacaggaaaaaaggtacatcaagccatttgaaaacaaaaatttattgcttctccttccaaagctttgtgaatttacaaaaaaaaggatgaaagtttacaaactgcttagttccaactaagcataagaggtgagaacgtacactgcagggccaccagcagcagctgtgcactgatgttaaaactggctcccccagacttgtagtgctgtcttcagggggctgcattccttacacgccacctcttgtgacataggtcattggtcaagccgctggaatgctacagaggtttttttggttttgagaggcttttttttgttttgccttcctactataaaagcgaaattttcagttcatttctgaaaaataaattggtcaataaattca

SEQ ID NO: 32408 - DNA, 2114 bp, Homo sapiens
gggttccagttgcctctctcgggtcctgcccatgcctcccccgctcctaacccaactttagttcggtgttttcctcgggctttgtctctatcccagccccttctcccaagcggcgggggcgaacgctttgtttcctttaaagtcacttcttccctgggtttaaggtttcccgcgattccacctctggccggttgtcagtgtctgagggaagtagtctggatgaagtggtgtccaaagtcacatgtcagcatggatccgcatcctttttatttgacaagtttagaaacctgctgaagtggtatgctaaggagttcaaagacccactgctacaggagcccccagcctggtttaagtcctttctgttttgcgagcttgtgtttcagctgcctttctttcccattgcaacgtatgccttcctcaaaggaagctgcaagtggattcgaactcctgcaatcatctactctgttcacaccatgacaaccttaattccgatactctccacatttctgtttgaggatttctccaaagccagtggtttcaagggacaaagacctgagactttgcatgaacggttaacccttgtgtctgtctatgccccctacttactcatcccattcatacttttaattttcatgttgcggagcccctactacaagtatgaagagaaaagaaaaaaaaaatgaaggaaacaaccactggcccagggtagagatgcctacagggtggttgcttgttggatacaatacaaggaacactgctcagaacccacgtcttcagcagcatttgaaacactggcagcaatgcacaagagcaagatggtgtcaggaaccatgtcaaaccctcaccttcttccattttttttttttttttaagacagtctcactctgttgcccaggctggagtaaagggcagtggcatgatctcggctcactgcaacctccgcctcctgggctcaagccatcttccttagcctcccaagtagctagaactacaggtgtgtaccaacacgtatggctaatttgttttgttttttttgtgtgtgtggagacagggttttgccatgttgcccaggttggtctcgaacgcctaggctcaagtgatctgcccacctcagtctccctaagtgctgggattacagacgtgaaccactgggcccagcccaaaccttcaccttctaagggcactgggatgaacagaccgatcggcttgagggtgggcaaaggggtgtgggctaggttataaggaagtggtaccaaataactgtgtgcctgagttccaccgcaagattactaaaagcaggaccagaccagaaactgctaaagaacatggcctgtttgacatgttcatgagtcacctgacccacagcatatatgcttatgactaaaccctccactcctgattctcaagagtgtatcacctgtcagcaaaatgaatagtgggatattttgggccattttaaatgtgaaattttgcctctttaatgttaattcaaaactatatcaatgttttcttgttcccacctctaacccaaggaaaaaagagaaaacatactatgcaaaggaagtttaaacttaagttttccttaagggtcagcccaacaatgactttcagtcaaatggattaaactggaaaatgtttttgtttctgttgtaaacagatcatcctaggcgaaagttttttttgtttgtttgcttttaaattagtttatttctaaatcttagtcttccacatttctagaggccacctgacacaagtccctgtatctgaagtctagcatctcaaggctgatctggaagtgtgctagtatgctccctagtggataacttaatcttttaatacagttccgtcattcccatcttgttttcagaagagaaggtggctacagccaggcataacatatccactgtgtgcatagagggtctcttcacgttgatgcttggcattccatcagctttctctaagtctttgctcaagttcaaccttaaaatgatgttagacaacaggtcccagtcagttccctctattttcacccattttgctcacaagccatattggcccgattagtggtactgtctgactcacgtgtgtgatccaaataaaggtagctgctgacc

SEQ ID NO: 32409 - DNA, 2604 bp, Homo sapiens
aaacctgcgaacgcttgggctgggtcggagctgcggggggcctgggaggagagaggggagaagagagaaggaaggagagcgcctgccgggatggctgagctgcctcggcgagcagccttggggttgcacgctcttgtgggagatgctgctgttgcttccaggtcggcaagagcggttctaacaccatcgcctctcaccctctttcctgtaaatccctagagaaacgtccctggcctctccgccgcgacattcccagcctgcatccccctacagcctaggcggcgcgctcccgcacgctggagcgccggtcgccagcaggacgccctctcccgcgccgactcgcccctctctgccctgctgctgctgctcctctgacacctccgcccccaccatctccagctcggagagacgccacccagccgcggcccgcactcgcggcccggggtcacgcgcggaagaggggcgctagtccggaccccgccttcggtagggggcgtcctggagcggagagtgaggcgaatggtatatgagtgtgcgggtagcccaccctgaagcccgagcttctcatttgagccatccccgcctagccccactcgggccagcgcctggcgagcgagcccatctgtggcttccgcggccgcctcctccttgcatccttgcacctcctcgtcgacccctccctcccgggacctgcatcctgctccaccaatcagagcccgactgcctcttcccacgtgaccccgggcgggctgaggacctgctgcttcccaaacgccagagggatgcgggcggcagagctcgagaggcggctgccgggctgcggggcgccttgactctccctccaccctgcctcctcgggctccactcgtctgcccctggactcccgtctcctcctgtcctccggcttcccagagctccctccttatggcagcagcttcccgcgtctccggcgcagcttctcagcggacgaccctctcgctccggggctgagcccagtccctggatgttgctgaaactctcgagatcatgcgcgggtttggctgctgcttccccgccgggtgccactgccaccgccgccgcctctgctgccgccgtccgcgggatgctcagtagcccgctgcccggcccccgcgatcctgtgttcctcggaagccgtttgctgctgcagagttgcacgaactagtcatggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggagtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcacacaatatagttttttctttcccatgtatttgttatatataataaatactcagtgatgagaaaaaa

SEQ ID NO: 32410 - DNA, 3364 bp, Homo sapiens
atggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggaggtaggagttgcctttttacatatttgaagatttactggtggatattattatgtatatttacttatgtatgttccatttcagatatttaagacaaatttcatattttgcattttaggaaaggtgaaaccataaaaaattgtcaccatattaagtacatgtatataccgtgcaaattatttggcatacttatgaatcatactctatctccagttaaccttccttgttcatttgtttgtttgtttgtttgtaagttatctttgatatggataggcataatgtaaaaacttctgaagagaagcatgtaagcatatttggcagggaagaaagaattcatgaggaaatcatttaaatattggatttttaaatatatgacactgctctcaattactaggtgctaataagacatacataacctaccatatagccaaggttttaattatcagatttataatttgaaactgaaggaactttagttcataaaagtgaaaaagataaaatgaagtccaatgaaagtaaaatattatctttgcttccttgattaaatctatagttatttttactaaagtatgatatatgttcccattatttagttttgtttagggaagtatataagatgagagagagagagagagaaactttaaaagtttgatctaatgtacttactaccaaataaagattttacctatagattgaaactaaattgtaaatgtcccaaatacttttcccgatgaaattcaaacaaaattagacttttatacacacaaagcaaaacaaaacacaacctatatataatttcaagattaagaaaaacaaaacaaataaaagcattctctcaagaccttgcttcagttgtgtaaaataattaaatgtgctattccaagttgattttagtttttaaatacagaatttgataaaagataagtaaaagaaggccttgggttcagggtggcagatatttagtgcaccctttatctagttcaggaaacacttgaaagatttatcaagtttccttatgtaatgaaagacttaactagttcaaataagcaatacccacagaacataattagagcagcatattggagcacaatttttttttcataaagactaaaactgaacagcagcagattgaaacacaatttttttcctaaagactaaaactgaacagcagtcaagactcaagcatagaatatgtttcaatgtcccatgatgttggacagtcctttgatgtctggacagtctttctctacttctaataaaagttttcctagctgattaatatagtattcccaagaaagcgtccctagaggttttgaaaataagaccttagaatagcatattaaatcttaaagaaaaaaaaaagacaggaaaaaaggcagttcctttagtagatgttttaccatgggaatattattaataagaaatcaattaattttttaaaatgttgcttttgtaaggaaacagtttctatgcaaaattctgtatattttctagctgtttagttttatatgtagactacctaattttgcaaatattgtgctgagactgaactgttccactgtttacccaccagtcttgttaattttctagcatctttaaagacaaaataaaacataccaagaatgtcttcatttctctttctgttaaagcatcatcatttacttttttctgcttgactatcctaccatactgtacttcatatctttatttttctaacaataagatgtgaactttgtttcacatactagtttctagttttcattcattgttattagcacatgcaaatggaaatgaagtcaaactcactcttccctgttgcgttttatattaaaatctttggttcattatgttgtcttgtgatctgaataagacattttttcaggaaataattttaatctcatgaatatgacatgtataacttataccatataagtgaaacatcacttggaaaacactttattttctttctctttttctgttttttaatcactcttcctttcagttagaggtgcttcatagtaacttggagaaaacaaaaacaacttccgatgtttgctttagaaaaaaaaagcatataacacatttaattctgagcttattcttttaaataactgcagttctgaaaattgtggtgatgagtatttgctcctaattgcatacaatttttaaaattagagactgatcaggtttttctcaacagaactgcttgtttttctagtctacatgttactttggtctgtaagactattagttttaattttctttaaattctttattgagggatgccaaaaatgcttagtaactaaaacctaaaaacctagtttagaataacttgcacaaattcagttcacatatccattgggttgtaatcgtaagatatatttgacttgctatctctcttatacagatgatagactttcctctgtatttttgtagaattcgtattaccaaggttttgagagggcagaatcagcttccttcatttttgaataaagcaaaagtgattgaataacttgtgattgtttggctaatccaacaattgtaactagtgattgttctaactaatctctatataacatattctcagtaatgtgtatttaattaataattgggtttacttggcaagcactttggatggttaatagttattttctaatttcttattttaacaaaagttaatataattccaaaatggagtacactgaacaaaagagtgaagggaacaaatttacttgtaaaacatttatcatgtgtgactatcataaatgatatcattaaacttacaaatctaaaatcatgtaaaaatatatcaaatattactttttaaaaattttcctatattttagcgtgaatgaatattacattagtaatgaaaattagacctgattattctaaaaataatttaagcttaacccatttgcacaaggg

SEQ ID NO: 32411 - DNA, 2959 bp, Homo sapiens
gagaagggtgtgcgtgatggagaaaattgggcaccagggctgctcccgagattctcagatctgatttccacgcttgctaccaaaatagtctgggcaggccacttttggaagtaggcgttatctagtgagcaggcggccgctttcgatttcgctttcccctaaatggctgagcttctcgccagcgcaggatcagcctgttcctgggactttccgagagccccgccctcgttccctcccccagccgccagtaggggaggactcggcggtacccggagcttcaggccccaccggggcgcggagagtcccaggcccggccgggaccgggacggcgtccgagtgccaatggctagctctaggtgtcccgctccccgcgggtgccgctgcctccccggagcttctctcgcatggctggggacagtactgctacttctcgccgactgggtgctgctccggaccgcgctgccccgcatattctccctgctggtgcccaccgcgctgccactgctccgggtctgggcggtgggcctgagccgctgggccgtgctctggctgggggcctgcggggtcctcagggcaacggttggctccaagagcgaaaacgcaggtgcccagggctggctggctgctttgaagccattagctgcggcactgggcttggccctgccgggacttgccttgttccgagagctgatctcatggggagcccccgggtccgcggatagcaccaggctactgcactggggaagtcaccctaccgccttcgttgtcagttatgcagcggcactgcccgcagcagccctgtggcacaaactcgggagcctctgggtgcccggcggtcagggcggctctggaaaccctgtgcgtcggcttctaggctgcctgggctcggagacgcgccgcctctcgctgttcctggtcctggtggtcctctcctctcttggggagatggccattccattctttacgggccgcctcactgactggattctacaagatggctcagccgataccttcactcgaaacttaactctcatgtccattctcaccatagccagtgcagtgctggagttcgtgggtgacgggatctataacaacaccatgggccacgtgcacagccacttgcagggagaggtgtttggggctgtcctgcgccaggagacggagtttttccaacagaaccagacaggtaacatcatgtctcgggtaacagaggacacgtccaccctgagtgattctctgagtgagaatctgagcttatttctgtggtacctggtgcgaggcctatgtctcttggggatcatgctctggggatcagtgtccctcaccatggtcaccctgatcaccctgcctctgcttttccttctgcccaagaaggtgggaaaatggtaccagttgctggaagtgcaggtgcgggaatctctggcaaagtccagccaggtggccattgaggctctgtcggccatgcctacagttcgaagctttgccaacgaggagggcgaagcccagaagtttagggaaaagctgcaagaaataaagacactcaaccagaaggaggctgtggcctatgcagtcaactcctggaccactagtatttcaggtatgctgctgaaagtgggaatcctctacattggtgggcagctggtgaccagtggggctgtaagcagtgggaaccttgtcacatttgttctctaccagatgcagttcacccaggctgtggaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatgtcttagtgctacaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacagaggtagacgaggctgggagccagctgtcagggggtcagcgacaggcagtggcgttggcccgagcattgatccggaaaccgtgtgtacttatcctggatgatgccaccagtgccctggatgcaaacagccagttacaggtggagcagctcctgtacgaaagccctgagcggtactcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtaggcagctgcctccaggatgagttacttgaaatttgccttgagtgtgttacctcctttccaagctcctcgtgataatgcagacttcctggagtacaaacacaggatttgtaattccttactgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgta

SEQ ID NO: 32412 - DNA, 2959 bp, Homo sapiens; identical to SEQ ID NO: 32411

SEQ ID NO: 32413 - DNA, 2959 bp, Homo sapiens; identical to SEQ ID NO: 32411

SEQ ID NO: 32414 - DNA, 2959 bp, Homo sapiens; identical to SEQ ID NO: 32411

SEQ ID NO: 32415 - DNA, 2959 bp, Homo sapiens; identical to SEQ ID NO: 32411

SEQ ID NO: 32416 - DNA, 2182 bp, Homo sapiens
atctctaacaggaggcttttctacttcatgatctccagccttcctaataaaatcctgaaagttctggtagagcaaccacagggtagtgagttccagggcagcctatttaggttcgggattgagacgtcagtgtttcctttctgctgatgccctccaggataatggggagatggccattccattctttacgggccgcctcactgactggattctacaagatggctcagccgataccttcactcgaaacttaactctcatgtccattctcaccatagccagtgcagtgctggagttcgtgggtgacgggatctataacaacaccatgggccacgtgcacagccacttgcagggagaggtgtttggggctgtcctgcgccaggagacggagtttttccaacagaaccagacaggtaacatcatgtctcgggtaacagaggacacgtccaccctgagtgattctctgagtgagaatctgagcttatttctgtggtacctggtgcgaggcctatgtctcttggggatcatgctctggggatcagtgtccctcaccatggtcaccctgatcaccctgcctctgcttttccttctgcccaagaaggtgggaaaatggtaccagttgctggaagtgcaggtgcgggaatctctggcaaagtccagccaggtggccattgaggctctgtcggccatgcctacagttcgaagctttgccaacgaggagggcgaagcccagaagtttagggaaaagctgcaagaaataaagacactcaaccagaaggaggctgtggcctatgcagtcaactcctggaccactagtatttcaggtatgctgctgaaagtgggaatcctctacattggtgggcagctggtgaccagtggggctgtaagcagtgggaaccttgtcacatttgttctctaccagatgcagttcacccaggctgtggaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatgtcttagtgctacaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacagaggtagacgaggctgggagccagctgtcagggggtcagcgacaggcagtggcgttggcccgagcattgatccggaaaccgtgtgtacttatcctggatgatgccaccagtgccctggatgcaaacagccagttacaggtggagcagctcctgtacgaaagccctgagcggtactcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtaggcagctgcctccaggatgagttacttgaaatttgccttgagtgtgttacctcctttccaagctcctcgtgataatgcagacttcctggagtacaaacacaggatttgtaattccttactgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgt

SEQ ID NO: 32417 - DNA, 2959 bp, Homo sapiens
gagaagggtgtgcgtgatggagaaaattgggcaccagggctgctcccgagattctcagatctgatttccacgcttgctaccaaaatagtctgggcaggccacttttggaagtaggcgttatctagtgagcaggcggccgctttcgatttcgctttcccctaaatggctgagcttctcgccagcgcaggatcagcctgttcctgggactttccgagagccccgccctcgttccctcccccagccgccagtaggggaggactcggcggtacccggagcttcaggccccaccggggcgcggagagtcccaggcccggccgggaccgggacggcgtccgagtgccaatggctagctctaggtgtcccgctccccgcgggtgccgctgcctccccggagcttctctcgcatggctggggacagtactgctacttctcgccgactgggtgctgctccggaccgcgctgccccgcatattctccctgctggtgcccaccgcgctgccactgctccgggtctgggcggtgggcctgagccgctgggccgtgctctggctgggggcctgcggggtcctcagggcaacgggtggctccaagagcgaaaacgcaggtgcccagggctggctggctgctttgaagccattagctgcggcactgggcttggccctgccgggacttgccttgttccgagagctgatctcatggggagcccccgggtccgcggatagcaccaggctactgcactggggaagtcaccctaccgccttcgttgtcagttatgcagcggcactgcccgcagcagccctgtggcacaaactcgggagcctctgggtgcccggcggtcagggcggctctggaaaccctgtgcgtcggcttctaggctgcctgggctcggagacgcgccgcctctcgctgttcctggtcctggtggtcctctcctctcttggggagatggccattccattctttacgggccgcctcactgactggattctacaagatggctcagccgataccttcactcgaaacttaactctcatgtccattctcaccatagccagtgcagtgctggagttcgtgggtgacgggatctataacaacaccatgggccacgtgcacagccacttgcagggagaggtgtttggggctgtcctgcgccaggagacggagtttttccaacagaaccagacaggtaacatcatgtctcgggtaacagaggacacgtccaccctgagtgattctctgagtgagaatctgagcttatttctgtggtacctggtgcgaggcctatgtctcttggggatcatgctctggggatcagtgtccctcaccatggtcaccctgatcaccctgcctctgcttttccttctgcccaagaaggtgggaaaatggtaccagttgctggaagtgcaggtgcgggaatctctggcaaagtccagccaggtggccattgaggctctgtcggccatgcctacagttcgaagctttgccaacgaggagggcgaagcccagaagtttagggaaaagctgcaagaaataaagacactcaaccagaaggaggctgtggcctatgcagtcaactcctggaccactagtatttcaggtatgctgctgaaagtgggaatcctctacattggtgggcagctggtgaccagtggggctgtaagcagtgggaaccttgtcacatttgttctctaccagatgcagttcacccaggctgtggaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatgtcttagtgctacaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacagaggtagacgaggctgggagccagctgtcagggggtcagcgacaggcagtggcgttggcccgagcattgatccggaaaccgtgtgtacttatcctggatgatgccaccagtgccctggatgcaaacagccagttacaggtggagcagctcctgtacgaaagccctgagcggtactcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtaggcagctgcctccaggatgagttacttgaaatttgccttgagtgtgttacctcctttccaagctcctcgtgataatgcagacttcctggagtacaaacacaggatttgtaattccttactgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgta

SEQ ID NO: 32418 - DNA, 2959 bp, Homo sapiens
gagaagggtgtgcgtgatggagaaaattgggcaccagggctgctcccgagattctcagatctgatttccacgcttgctaccaaaatagtctgggcaggccacttttggaagtaggcgttatctagtgagcaggcggccgctttcgatttcgctttcccctaaatggctgagcttctcgccagcgcaggatcagcctgttcctgggactttccgagagccccgccctcgttccctcccccagccgccagtaggggaggactcggcggtacccggagcttcaggccccaccggggcgcggagagtcccagacccggccgggaccgggacggcgtccgagtgccaatggctagctctaggtgtcccgctccccgcgggtgccgctgcctccccggagcttctctcgcatggctggggacagtactgctacttctcgccgactgggtgctgctccggaccgcgctgccccgcatattctccctgctggtgcccaccgcgctgccactgctccgggtctgggcggtgggcctgagccgctgggccgtgctctggctgggggcctgcggggtcctcagggcaacggttggctccaagagcgaaaacgcaggtgcccagggctggctggctgctttgaagccattagctgcggcactgggcttggccctgccgggacttgccttgttccgagagctgatctcatggggagcccccgggtccgcggatagcaccaggctactgcactggggaagtcaccctaccgccttcgttgtcagttatgcagcggcactgcccgcagcagccctgtggcacaaactcgggagcctctgggtgcccggcggtcagggcggctctggaaaccctgtgcgtcggcttctaggctgcctgggctcggagacgcgccgcctctcgctgttcctggtcctggtggtcctctcctctcttggggagatggccattccattctttacgggccgcctcactgactggattctacaagatggctcagccgataccttcactcgaaacttaactctcatgtccattctcaccatagccagtgcagtgctggagttcgtgggtgacgggatctataacaacaccatgggccacgtgcacagccacttgcagggagaggtgtttggggctgtcctgcgccaggagacggagtttttccaacagaaccagacaggtaacatcatgtctcgggtaacagaggacacgtccaccctgagtgattctctgagtgagaatctgagcttatttctgtggtacctggtgcgaggcctatgtctcttggggatcatgctctggggatcagtgtccctcaccatggtcaccctgatcaccctgcctctgcttttccttctgcccaagaaggtgggaaaatggtaccagttgctggaagtgcaggtgcgggaatctctggcaaagtccagccaggtggccattgaggctctgtcggccatgcctacagttcgaagctttgccaacgaggagggcgaagcccagaagtttagggaaaagctgcaagaaataaagacactcaaccagaaggaggctgtggcctatgcagtcaactcctggaccactagtatttcaggtatgctgctgaaagtgggaatcctctacattggtgggcagctggtgaccagtggggctgtaagcagtgggaaccttgtcacatttgttctctaccagatgcagttcacccaggctgtggaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatgtcttagtgctacaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacagaggtagacgaggctgggagccagctgtcagggggtcagcgacaggcagtggcgttggcccgagcattgatccggaaaccgtgtgtacttatcctggatgatgccaccagtgccctggatgcaaacagccagttacaggtggagcagctcctgtacgaaagccctgagcggtactcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtaggcagctgcctccaggatgagttacttgaaatttgccttgagtgtgttacctcctttccaagctcctcgtgataatgcagacttcctggagtacaaacacaggatttgtaattccttactgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgta

SEQ ID NO: 32419 - DNA, 2959 bp, Homo sapiens; identical to SEQ ID NO: 32411

SEQ ID NO: 32420 - DNA, 2182 bp, Homo sapiens; identical to SEQ ID NO: 32416

SEQ ID NO: 32421 - DNA, 2182 bp, Homo sapiens; identical to SEQ ID NO: 32416

SEQ ID NO: 32422 - DNA, 2182 bp, Homo sapiens; identical to SEQ ID NO: 32416

SEQ ID NO: 32423 - DNA, 2182 bp, Homo sapiens; identical to SEQ ID NO: 32416

SEQ ID NO: 32424 - DNA, 2182 bp, Homo sapiens; identical to SEQ ID NO: 32416

SEQ ID NO: 32425 - DNA, 2182 bp, Homo sapiens; identical to SEQ ID NO: 32416

SEQ ID NO: 32426 - DNA, 2182 bp, Homo sapiens; identical to SEQ ID NO: 32416

SEQ ID NO: 32427 - DNA, 5684 bp, Homo sapiens
gagccctgacgcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctctaggagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttgtaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactactactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattcta

SEQ ID NO: 32428 - DNA, 2497 bp, Homo sapiens
gaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccaaaaccctttggaagttcatgatattttgaatttcaatggatatttcctgggaataatgagttcaaatgaacgaatatgtggaacaaagcatcaccaacatttattttttcaggatgaggtgatggacaaaaccatcacagggaaattgaggcaaatagtacatgtaaaacaatacttcgggtgagtccacctatcccaaagtcgtatcaaagaagtggctgcagattggagcccaaagcctttggttcctcagtttccaaatggattctcactaggtgggatcatgagtttgctttggacaccccaaattctaactatttcttttgtttcttacatcctttccctcttccccagccccttcccctcatgttacacctcttgctggtttgagacgtcaatcaccactgagaaagaattaaaccagtattttgagctggcaaaattcttagcctagtacaattccttcaattaaactgtagctcaac

SEQ ID NO: 32429 - DNA, 5684 bp, Homo sapiens
gagccctgacgcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctctaggagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggagtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactcctactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattcta

SEQ ID NO: 32430 - DNA, 2497 bp, Homo sapiens
gaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccaaaaccctttggaagttcatgatattttgaatttcagtggatatttcctgggaataatgagttcaaatgaacgaatatgtggaacaaagcatcaccaacatttattttttcaggatgaggtgatggacaaaaccatcacagggaaattgaggcaaatagtacatgtaaaacaatacttcgggtgagtccacctatcccaaagtcgtatcaaagaagtggctgcagattggagcccaaagcctttggttcctcagtttccaaatggattctcactaggtgggatcatgagtttgctttggacaccccaaattctaactatttcttttgtttcttacatcctttccctcttccccagccccttcccctcatgttacacctcttgctggtttgagacgtcaatcaccactgagaaagaattaaaccagtattttgagctggcaaaattcttagcctagtacaattccttcaattaaactgtagctcaac

SEQ ID NO: 32431 - DNA, 5684 bp, Homo sapiens
gagccctgacgcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctctaggagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactcctactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattcta

SEQ ID NO: 32432 - DNA, 2497 bp, Homo sapiens; identical to SEQ ID NO: 32430

SEQ ID NO: 32433 - DNA, 2497 bp, Homo sapiens
gaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaatgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccaaaaccctttggaagttcatgatattttgaatttcaatggatatttcctgggaataatgagttcaaatgaacgaatatgtggaacaaagcatcaccaacatttattttttcaggatgaggtgatggacaaaaccatcacagggaaattgaggcaaatagtacatgtaaaacaatacttcgggtgagtccacctatcccaaagtcgtatcaaagaagtggctgcagattggagcccaaagcctttggttcctcagtttccaaatggattctcactaggtgggatcatgagtttgctttggacaccccaaattctaactatttcttttgtttcttacatcctttccctcttccccagccccttcccctcatgttacacctcttgctggtttgagacgtcaatcaccactgagaaagaattaaaccagtattttgagctggcaaaattcttagcctagtacaattccttcaattaaactgtagctcaac

SEQ ID NO: 32434 - DNA, 5684 bp, Homo sapiens
gagccctgacgcccgccctggccgagcgtagctggcggaccagagccggtagcgaggttgggagagacggagcggacctcagcgctgaagcagaagcccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcataaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattacttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctctaggagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactactactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattcta

SEQ ID NO: 32435 - DNA, 2497 bp, Homo sapiens
gaggttgggagagacggagcggacctcagcgctgaagcagaagcccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaaggggagccagctggctgcgggacagaaacaacgtctggccattgcccgggcccttgtacgagacccgcgggtcctcatcctggatgaggctactagtgccctagatgtgcagtgcgagcaggccaaaaccctttggaagttcatgatattttgaatttcaatggatatttcctgggaataatgagttcaaatgaacgaatatgtggaacaaagcatcaccaacatttattttttcaggatgaggtgatggacaaaaccatcacagggaaattgaggcaaatagtacatgtaaaacaatacttcgggtgagtccacctatcccaaagtcgtatcaaagaagtggctgcagattggagcccaaagcctttggttcctcagtttccaaatggattctcactaggtgggatcatgagtttgctttggacaccccaaattctaactatttcttttgtttcttacatcctttccctcttccccagccccttcccctcatgttacacctcttgctggtttgagacgtcaatcaccactgagaaagaattaaaccagtattttgagctggcaaaattcttagcctagtacaattccttcaattaaactgtagctcaac

SEQ ID NO: 32436 - DNA, 2497 bp, Homo sapiens; identical to SEQ ID NO: 32435

SEQ ID NO: 32437 - DNA, 5684 bp, Homo sapiens
gagccctgacgcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaatgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctctaggagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactactactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattcta

SEQ ID NO: 32438 - DNA, 2497 bp, Homo sapiens
gaggttgggagagacggagcggacctcagcgctgaagcagaagcccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcataaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattacttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccaaaaccctttggaagttcatgatattttgaatttcaatggatatttcctgggaataatgagttcaaatgaacgaatatgtggaacaaagcatcaccaacatttattttttcaggatgaggtgatggacaaaaccatcacagggaaattgaggcaaatagtacatgtaaaacaatacttcgggtgagtccacctatcccaaagtcgtatcaaagaagtggctgcagattggagcccaaagcctttggttcctcagtttccaaatggattctcactaggtgggatcatgagtttgctttggacaccccaaattctaactatttcttttgtttcttacatcctttccctcttccccagccccttcccctcatgttacacctcttgctggtttgagacgtcaatcaccactgagaaagaattaaaccagtattttgagctggcaaaattcttagcctagtacaattccttcaattaaactgtagctcaac

SEQ ID NO: 32439 - DNA, 2497 bp, Homo sapiens; identical to SEQ ID NO: 32435

SEQ ID NO: 32440 - DNA, 5511 bp, Homo sapiens
gagccctgacgcccgccctggccgagcgtagctggcggaccagagccggtagcgaggttgggagagacggagcggacctcagcgctgaagcagaagcccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaaggggagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcaggcagttcagcgcgcccaccagatcctggtgctccaggagggcaagctgcagaagcttgcccagctccaggagggacaggacctctattcccgcctggttcagcagcggctgatggactgaggccccagggatactgggccctcttctcaggggcgtctccaggacccagagctgttcctgctttgagtttccctagagctgtgcggccagatagctgttcctgagttgcaagcacgatggagatttggacactgtgtgcttttggtggggtggagaggtggggtggggtggggtgtggtggggtggaggctgtctgtgtccaggaaacttaattccctggtgactagagctttgcctggtgatgaggagtattttgtggcataatacatatattttaaaatattttccttcttacgtgaactgtatacattcatatagaaaatttagacaatataaaaaagtacaaagaagaaaagtaaaagtacccattgtttcacttcctggagataaccatagttgctattttgctgcctgttccatcagtcgtttatctgttgtttgagatagaaattaaccaaaaatgacataaatattcatgagattgccttcctatatccctccttgttcctaccagtgtctgctattttgaagaagctagggtctggagggacagagaacagttccctgattaacagtattaataatgacattggtaacagctaccatttatagagttttaatgtgagtaggagctatgctaagtgtttttcatgtattatcgtttttaatcattatctccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaatagtaattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactactactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgattccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagt

SEQ ID NO: 32441 - DNA, 5511 bp, Homo sapiens; identical to SEQ ID NO: 32440

SEQ ID NO: 32442 - DNA, 5517 bp, Homo sapiens
gagccctgacgcccgccctggccgagcgtagctggcggaccagagccggtagcgaggttgggagagacggagcggacctcagcgctgaagcagaagcccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaaggggagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcaggcagttcagcgcgcccaccagatcctggtgctccaggagggcaagctgcagaagcttgcccagctccaggagggacaggacctctattcccgcctggttcagcagcggctgatggactgaggccccagggatactgggccctcttctcaggggcgtctccaggacccagagctgttcctgctttgagtttccctagagctgtgcggccagatagctgttcctgagttgcaagcacgatggagatttggacactgtgtgcttttggtggggtggagaggtggggtggggtggggtgtggtggggtggaggctgtctgtgtccaggaaacttaattccctggtgactagagctttgcctggtgatgaggagtattttgtggcataatacatatattttaaaatattttccttcttacgtgaactgtatacattcatatagaaaatttagacaatataaaaaagtacaaagaagaaaagtaaaagtacccattgtttcacttcctggagataaccatagttgctattttgctgcctgttccatcagtcgtttatctgttgtttgagatagaaattaaccaaaaatgacataaatattcatgagattgccttcctatatccctccttgttcctaccagtgtctgctattttgaagaagctagggtctggagggacagagaacagttccctgattaacagtattaataatgacattggtaacagctaccatttatagagttttaatgtgagtaggagctatgctaagtgtttttcatgtattatcgtttttaatcattatctccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaatagtaattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactactactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgattccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattcta

SEQ ID NO: 32443 - DNA, 2705 bp, Homo sapiens
gaatgaaggccttggttggggaaacgaaagcgaaagctgcccgagccctgacgcccgccctggccgagcgtagctggcggaccagagccggtagcgaggttgggagagacggagcggacctcagcgctgaagcagaagcccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaaggggagccagctggctgcgggacagaaacaacgtctggccattgcccgggcccttgtacgagacccgcgggtcctcatcctggatgaggctactagtgccctagatgtgcagtgcgagcaggccaatgggttctgggtgggtcccctgggtggtggctctgctagtgaatctgacccgactggattcctccatgactcaaggcacagactctccagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaat

SEQ ID NO: 32444 - DNA, 2705 bp, Homo sapiens
gaatgaaggccttggctggggaagcgaaagcgaaagctgcccgagccctgacgcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaatgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccaatgggttctgggtgggtcccctgggtggtggctctgctagtgaatctgacccgactggattcctccatgactcaaggcacagactctccagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaat

SEQ ID NO: 32445 - DNA, 2705 bp, Homo sapiens; identical to SEQ ID NO: 32443

SEQ ID NO: 32446 - DNA, 2705 bp, Homo sapiens
gaatgaaggccttggttggggaaacgaaagcgaaagctgcccgagccctgacgcccgccctggccgagcgtagctggcggaccagagccggtagcgaggttgggagagacggagcggacctcagcgctgaagcagaagcccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcataaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattacttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccaatgggttctgggtgggtcccctgggtggtggctctgctagtgaatctgacccgactggattcctccatgactcaaggcacagactctccagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaat

SEQ ID NO: 32447 - DNA, 2705 bp, Homo sapiens
gaatgaaggccttggttggggaaacgaaagcgaaagctgcccgagccctgacgcccgccctggccgagcgtagctggcggaccagagccggtagcgaggttgggagagacggagcggacctcagcgctgaagcagaagcccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaaggggagccagctggctgcgggacagaaacaacgtctggccattgcccgggcccttgtacgagacccgcgggtcctcatcctggatgaggctactagtgccctagatgtgcagtgcgagcaggccaatgggttctgggtgggtcccctgggtggtggctctgctagtgaatctgacccgactggattcctccatgactcaaggcacagactctccagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctatttctgtggagtggagagctcagtctgaatattcttggagaaagatgctgagtggcattgcagccttcctacttgggctaat

SEQ ID NO: 32448 - DNA, 2705 bp, Homo sapiens
gaatgaaggccttggctggggaagcgaaagcgaaagctgcccgagccctgacgcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccaatgggttctgggtgggtcccctgggtggtggctctgctagtgaatctgacccgactggattcctccatgactcaaggcacagactctccagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaat

SEQ ID NO: 32449 - DNA, 11183 bp, Homo sapiens
acagtctgggcaaccacaccggcgggccgttttgctcacagccccaccgcgccgggcagcgtctgcagctgctgcgtgcgagacccagaggctccggtcagcgcgccggccgcagggagtgcgagcacttgtgagccccgcgccgggccggtgaagtctggtgctgccgagcccgcttagaaagcacggccgcgcgctgtcggacgcaggcccacaggcccagccgacccaggcagcaattttcctagccccgccgccgttgccaaggcgaccgccgccgaatgttcccgccgcgggctccgccccccggccaatcggaccggcgctcggtgaagcccagattctctttgttccgcagccatttcaggccccggacaggaggcagtgccgcttcggccgaaggcccgagcgcccgaggcgtctgggatggtgtgggaccggcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggacagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaaaaaaaaaatctattcagtctactcacaaaacagtacattgtggaatattatggggaattgtaccaaaacaagaaccatataaatgatgcctagggacaagaaagaggaacaattctatagcgcacaataaaggaaacctaagaatgggagttacaaatagtaaagaagctttttttttttttttaatttaaagtttttttatgtaagttttcccacatgatggggccttgttttgcatgttgatgaagaactacacaaagaaaactaatatagttaaaagtcagcttgccttcccgtagtagaagcaggttcttggaagttacaatttaaggtaccccaaaaaagttggaaataaaacaaaacaaacataaacaatgaagcaccctgtgaaatgccaaatgagtcactccttttaccttttttggggtgggcagggagggaggaataaatggggttgggcatatcaaactaaagatgacatcttaattttgcattgaacattaatgtagcggatataatttgatgattatacttcattagatttaatttctaggccaagatgttactttttaaagtgcagtttaaggttcaggcatgcattctggctcatagtggttgaaagtaatttaaattagtgggaaagtagcatgcttgcatcacatagagtgagattggtattcatttacctatgttgcgccagtttgtgttgcagtttaccaattcaatatagccctgcatttaaagttcctttttaagatttgtggattttatttttattaagaacatagatatataaagtactgtagtttacaggtaggccttgaaatatcttttttaggatctgttaggaataagattgatattgtattgtgtgtaacctgcacaatgtggaaagctgatatacctgtgcaaaatctttgcctctgtgctgtcagtgtgatgtgctttctgcatggttatatactactagtgattttatcaaaacttctaaaatttaaattacgtggtaaaagatctgtaaaaggctgcataaatgttagttggcacataaagacaattgtagaagttgaaaaatgattgctatatttcaatgtttattcccactcaacatactgccttctaagcttccctttttttgttcaaagcatgatcttaaagatatgtttaagttaatggatgtaatgcagggttcctacactgtattttggcgcatgttggtggccctctgtgccctagatatatgcacacagggtgcaagttaaaagctacagagtgaaagttggtttggatcctcttcatttcatttgtttagcttttctgttatttttctctacttacatgtattcctgtgaataaatccttgttaagttaaccctttacttttccttccatgtgtattttcttatatactgtgaatgtgaaaacctaactggtacacttgatcttgtgttcatatgaaagtgcaagtctttattaatttggattgcctgaacagtgtatcccatgatgatgaaggaaaatggagagatttttctttttaactctgctggtcagagatgaagccacgcctttccatttttcaatgctgcatatttaatctgcaacaaaaatgttaagccataacagcctttttatattttagtttgtcacctttgcattgcagaataaatactgaataaccatttttataagcagttgctcctctttgcatggttctattctctaaaagtgttgaatgatacagccattgcactgaagtttgagctgtgtgcgtgtgaatttatactgtttcaaaaatttcaaatgcatggtagcatgtagaaaggtttttgttactatgtgtgtgtgtgtgttttgttttgttttgttctgttttttaacgttctttcacctttcctctactttggctttgcaaatttcagtctgtagagcctgaaattaaattattttatagtgcctgatatttttaatattataagttggattcaaagggtatacagcattttgttttctagtaccattgcttcactgggagctcaaaatttgcctccctgttagtctttaataactgagtagagtagcttttttattcttagattatagtgatattctgtagtgcttcaaatacttagaattctaatatgagagatagtttaatattctggaatagagagtattttaaattgaaatgaccaaattcgatttaaaacaaacacataacaatcttcagtaaagttatttgaacctgtggttgacaattctgtattgactaaaggcaatattgtcacctgtctcattaaaaattagtttccagttaggcagatgaataacactattaaaaatgcacccagttttgtagtcacttgactttttttttttatttaaatgaaatttaatttgaaaatagaaaataaaattaggtaaatatgactggcaacctgaatttgagttgggattctttgtgtatttttcccccttgaggttattgtttcttcctaatttatatttcagatacatagtgtagaacaggaatttgcagaagccatttaagttatcttttgaggtaagctctgatttagcatttattctgataaaatctaatacatcatgggatatatataaagcaacttaattcttgtggtgtagtcttaatagttttgaatgttgactgaatgtctataaaattgtgagtttgtctttgttacattccagtgtttctgcctcttggcatgcttaaagcacggcttacttcatctgctccttacacactaaaatgctgttagtgtgctcaactacagaaatagccgctgctaagtgatgtagattttctacttgaatatttttatgttgtaggaacctcaggaggtcagtgtttactgttttatatatgccttctttttcctgtttgagcttctctctttgaaggattctaacagaacaaagctgctgatcaacctaagttggaaacagaaagtgtaattaatataacttaaatgcatgtttggcagttccatgttacagtccattagcgagtgaacttagtgccacaggtattcatttattcaggaaagaattttgctttttgtattgtctaatctcttcaatgacttcatactgtgtaaaaaaaaatcactttttaatattttttggttggttatttcccaaataatcaacatgtaaataatcttttaagagccagttctgatgctttacattattgctacttgattttgttatgcaagttagatttcagaagaatagattttaaaacacttaaccaagccattacatcttaaaaacaaaacaagtagcatacattttgtaattaacattgataaacactgtgatttttttggttaagactttttcattgatctgaattgcttaaattgcatatattgtaaaataggatcagatgtatattttaaactaatttcaatggattttcctcttgaaatgctttgtctactcagttataaaatattcagatacaagttttatctcaggtgaatactcttgtattgtttttgctttggtgacatgcttataaagggtcatcctagttacattctttgttttttaagtgtatttcattgagaatctttccatttagtctgatttttttcctaatattctagcaggctggggtggtataaagccctcctgacaagccttttgcctacaggtttacctgaaaatgagctacatatggtcgtcattttcttcaaactctcaaaataggaaagtggaaatttttctcccctatataaaattattctgcctagcagaaatgccagaaataaattaattgcatcttagtctaaatttaagtcctttgccatgaggaaaaagtggttttttgcttcatatggtaaatctatattattcatattgaatgtattaacagataatggtgcaaaagcattcttcccaggggaagagtgtatcatgcataactgcaatttaagtccttcctttgataatacttcaaaacatacacagctttgcttactgaattatttttgcaaataatacaaggaggggaaactaacttgctactagtgttgttaatgaagtataggccttggaacatttaagaaaactggtcttcagatagttaagggcttgggataatttaagtgaaaagtgagatcagtaatgagctgtgttgttaacaatattatctggtaataataccatgcaatatagcgttgtataccaacttagtgcattttatactgtattaaatatggagatacttctaatgcctctctaaaattaaattttacataaaagttagttttattcacctttaggctttccaagtgaattgtgactaattttttcaatcttacatagatctttcacccattagcattacttacgtagataattctttatgcctagttattatacatattaatttttaaggtatacatttaaattacacaattgttcattgtggtttgtatcccagaatgtgttgtgttttttaaaagatgcataatagctgaatgtatgcatgactttgaaagaagttaaaatggtgattttttttcacctcttgtacattttaaaaccaggccaaatctatttgccaagcagtgtatcactaataagaaaagcagtttttccttttattgcagtttttgtttatctgccatagaatttccttatactgtggcttggtattattcaagattagctatttcgctggtattacatctttttaaaagcctattataacatggttagcctataaggcagtgttggtccccttctaatattggcctcataaaggggttccactgtactttccgcatattactgtgttgttgttttcctttgtggatatataagcaaattgagcttgggtgatttttatggagacaataattagacaatactgtataattagttttacttaatagattatcatcttgtgagaagagatgtttaaacgtggtaaatcacttcatattacaaaacagttttacacttaatatgttaacattgggtgcaataatttagtagcattagctttagttacaaatataactggatctttctgctgacaacttaggttgtatgagttatgcttaaaagctttaaatctgatgtttcctgtacctgccacactatgttagaatgtgtccttcaaacatatcctcctgcaacttctcaaactgtactaaattgatatttcttgaagtctaactctgtgctaacagatctccattttaaatagaatacggttttaatttttgataagctgctgaattttaaagagagttttttggggccaccaaatattttggatcatgcagagaatatatattgtactgtagtaattttgtatttacatttgtatgatgtgacataatagatgtgaatgttaatcactgcttgactatgttaataaagttgtttaactatagatgttgcactctgatttttaatgaaaggaaatgagttttctttttccctcttaccccattttggatctagataagccttatgttttttgggatttttttccttgtttttagtttgaggttttgttttgttttttccttagcttacacattagtacacttttgttgttgaacatcatttatttcttaaaacaagtgttttcttatttgtatagtatagtaaaaacctgtttttccacattttaacttaactccttgatgtgttttaaacagttgattataggttctgctgtttgaggataggggacatactattctgtaaaaggaattaaaggcgaaattgtgaatataaaaagttgatgtaaggagagattgcatgagtgtgtatgaatgtatgtcctattaaggcttcctctttatccttcaaacagttaagatttgtaatttggggaattaacatttataagagtaattttttcttcaggttgtaaggcattaatatagttgcatgttactaattaaatgtattaacacatttcagggagtatgtgtgcataactgtcatggttttttttgttttttgtcttgtttttgagatggagtcttgctctgttgcccaggctggagtgcagtggcacagtcttgtctcactgcaacctctgcctcccgggttcaaacgactctcctgcctcagcttcccaagtagttgggattaaggcatgtgccgtcacacccggctaacttttatattttcagtaaagatgggggttcaccatgttggccaggctagtctcgaactcctggcctcaggtgatccacctgtctcggcctctcaaagtgttgggattacagctgtgagccaccatgcctggccttgtcatacagccttttgagatttagaacaggaaagagcctaaaattaaatcagtacaattccaaaacttttaagagaggtgaggcttgggtttctttttctttgttacctggccaagaaaatatttgagaagagagagttctcttgtgttaacaagaaaataaaattgaaacttggacatcatgttctaaaacacagcctcaagagtttaatattccagaattttaggacttaggttgtggggaaaagataattaaagtcatcctaattcttgttcaagattaggaaccaaaagtcttttctaagtcgtcaatattttagtgatactaaagccctatccattttatgcaaatgatctttttcttctcagttcaggtgatgaaaccatcgtaatgataaatgagtaaggctggcttaacaattcttggactggcgggcattcttgtaatgagttcataatcagtatgactccacaatttcacgtgattctttaagaatgattggaaaagtggcagcaggaactacagagctaacttgaatttcctttgtgttctatacagttgaatatggaattaccaaagctctgtcattttaaaaattctttatttctgagttgttaatttgatgtaaaagtgtaagaacccccgaaacatctccattattcagatagacacaaataatgtacacatcacaattagtatatattttttttaattgagaggactctggctctgtctcccagtcttcagtggcacgatatctgctccctgcaacttccgcctcctaggttcaagcaattctcccatctcagcctcccaagtagctgggattacaggcgcacgccaccaggcctggctaatttttttttttttttttttttttttttttttttaggagagagtttggccgtgttggccaggctggtctcgaactcctgacctcgagtgaacacctcgagtggtacgcccacctttgcctcccaaattgctgggattacagttgtgagccaccgcccctggcgacaatttgtaaatttaacgcaatttctaaaccattggcaagaacaatacagagaagagttgttatactgagaccctttaggtttttgtaccagtcaattcttacatgcatgttatggcagtctcactctgatgatttaaatcttaagtattcttttcaagctttgtgttacttcttgaagaacttgaaacaattttaagaaagacaagtgaacagttaaatgaattgtaatacaactacctagtgataactgctgttaatatcctgtgcacatatataaatatatggtgaatttgtgtttttagttatatccagaattgtttgttaatatacatggacatacctacatattattctataagcaatttatgcaactgtcttactgttgttggacattcagaagttttttctaatttttcactcttagaaataaagttttagtgagagtcgcaa

SEQ ID NO: 32450 - DNA, 863 bp, Homo sapiens
cagattctctttgttccgcagccatttcaggccccggacaggaggcagtgccgcttcggccgaaggcccgagcgcccgaggcgtctgggatggtgtgggaccggcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgata

SEQ ID NO: 32451 - DNA, 8409 bp, Homo sapiens
gaatgttcccgccgcgggctccgccccccggccaatcggaccggcgctcggtgaagcccagattctctttgttccgcagccatttcaggccccggacaggaggcagtgccgcttcggccgaaggcccgagcgcccgaggcgtctgggatggtgtgggaccggcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaaggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggacagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaaaaaaaaaatctattcagtctactcacaaaacagtacattgtggaatattatggggaattgtaccaaaacaagaaccatataaatgatgcctagggacaagaaagaggaacaattctatagcgcacaataaaggaaacctaagaatgggagttacaaatagtaaagaagctttttttttttttttaatttaaagtttttttatgtaagttttcccacatgatggggccttgttttgcatgttgatgaagaactacacaaagaaaactaatatagttaaaagtcagcttgccttcccgtagtagaagcaggttcttggaagttacaatttaaggtaccccaaaaaagttggaaataaaacaaaacaaacataaacaatgaagcaccctgtgaaatgccaaatgagtcactccttttaccttttttggggtgggcagggagggaggaataaatggggttgggcatatcaaactaaagatgacatcttaattttgcattgaacattaatgtagcggatataatttgatgattatacttcattagatttaatttctaggccaagatgttactttttaaagtgcagtttaaggttcaggcatgcattctggctcatagtggttgaaagtaatttaaattagtgggaaagtagcatgcttgcatcacatagagtgagattggtattcatttacctatgttgcgccagtttgtgttgcagtttaccaattcaatatagccctgcatttaaagttcctttttaagatttgtggattttatttttattaagaacatagatatataaagtactgtagtttacaggtaggccttgaaatatcttttttaggatctgttaggaataagattgatattgtattgtgtgtaacctgcacaatgtggaaagctgatatacctgtgcaaaatctttgcctctgtgctgtcagtgtgatgtgctttctgcatggttatatactactagtgattttatcaaaacttctaaaatttaaattacgtggtaaaagatctgtaaaaggctgcataaatgttagttggcacataaagacaattgtagaagttgaaaaatgattgctatatttcaatgtttattcccactcaacatactgccttctaagcttccctttttttgttcaaagcatgatcttaaagatatgtttaagttaatggatgtaatgcagggttcctacactgtattttggcgcatgttggtggccctctgtgccctagatatatgcacacagggtgcaagttaaaagctacagagtgaaagttggtttggatcctcttcatttcatttgtttagcttttctgttatttttctctacttacatgtattcctgtgaataaatccttgttaagttaaccctttacttttccttccatgtgtattttcttatatactgtgaatgtgaaaacctaactggtacacttgatcttgtgttcatatgaaagtgcaagtctttattaatttggattgcctgaacagtgtatcccatgatgatgaaggaaaatggagagatttttctttttaactctgctggtcagagatgaagccacgcctttccatttttcaatgctgcatatttaatctgcaacaaaaatgttaagccataacagcctttttatattttagtttgtcacctttgcattgcagaataaatactgaataaccatttttataagcagttgctcctctttgcatggttctattctctaaaagtgttgaatgatacagccattgcactgaagtttgagctgtgtgcgtgtgaatttatactgtttcaaaaatttcaaatgcatggtagcatgtagaaaggtttttgttactatgtgtgtgtgtgtgttttgttttgttttgttctgttttttaacgttctttcacctttcctctactttggctttgcaaatttcagtctgtagagcctgaaattaaattattttatagtgcctgatatttttaatattataagttggattcaaagggtatacagcattttgttttctagtaccattgcttcactgggagctcaaaatttgcctccctgttagtctttaataactgagtagagtagcttttttattcttagattatagtgatattctgtagtgcttcaaatacttagaattctaatatgagagatagtttaatattctggaatagagagtattttaaattgaaatgaccaaattcgatttaaaacaaacacataacaatcttcagtaaagttatttgaacctgtggttgacaattctgtattgactaaaggcaatattgtcacctgtctcattaaaaattagtttccagttaggcagatgaataacactattaaaaatgcacccagttttgtagtcacttgactttttttttttatttaaatgaaatttaatttgaaaatagaaaataaaattaggtaaatatgactggcaacctgaatttgagttgggattctttgtgtatttttcccccttgaggttattgtttcttcctaatttatatttcagatacatagtgtagaacaggaatttgcagaagccatttaagttatcttttgaggtaagctctgatttagcatttattctgataaaatctaatacatcatgggatatatataaagcaacttaattcttgtggtgtagtcttaatagttttgaatgttgactgaatgtctataaaattgtgagtttgtctttgttacattccagtgtttctgcctcttggcatgcttaaagcacggcttacttcatctgctccttacacactaaaatgctgttagtgtgctcaactacagaaatagccgctgctaagtgatgtagattttctacttgaatatttttatgttgtaggaacctcaggaggtcagtgtttactgttttatatatgccttctttttcctgtttgagcttctctctttgaaggattctaacagaacaaagctgctgatcaacctaagttggaaacagaaagtgtaattaatataacttaaatgcatgtttggcagttccatgttacagtccattagcgagtgaacttagtgccacaggtattcatttattcaggaaagaattttgctttttgtattgtctaatctcttcaatgacttcatactgtgtaaaaaaaaatcactttttaatattttttggttggttatttcccaaataatcaacatgtaaataatcttttaagagccagttctgatgctttacattattgctacttgattttgttatgcaagttagatttcagaagaatagattttaaaacacttaaccaagccattacatcttaaaaacaaaacaagtagcatacattttgtaattaacattgataaacactgtgatttttttggttaagactttttcattgatctgaattgcttaaattgcatatattgtaaaataggatcagatgtatattttaaactaatttcaatggattttcctcttgaaatgctttgtctactcagttataaaatattcagatacaagttttatctcaggtgaatactcttgtattgtttttgctttggtgacatgcttataaagggtcatcctagttacattctttgttttttaagtgtatttcattgagaatctttccatttagtctgatttttttcctaatattctagcaggctggggtggtataaagccctcctgacaagccttttgcctacaggtttacctgaaaatgagctacatatggtcgtcattttcttcaaactctcaaaataggaaagtggaaatttttctcccctatataaaattattctgcctagcagaaatgccagaaataaattaattgcatcttagtctaaatttaagtcctttgccatgaggaaaaagtggttttttgcttcatatggtaaatctatattattcatattgaatgtattaacagataatggtgcaaaagcattcttcccaggggaagagtgtatcatgcataactgcaatttaagtccttcctttgataatacttcaaaacatacacagctttgcttactgaattatttttgcaaataatacaaggaggggaaactaacttgctactagtgttgttaatgaagtataggccttggaacatttaagaaaactggtcttcagatagttaagggcttgggataatttaagtgaaaagtgagatcagtaatgagctgtgttgttaacaatattatctggtaataataccatgcaatatagcgttgtataccaacttagtgcattttatactgtattaaatatggagatacttctaatgcctctctaaaattaaattttacataaaagttagttttattcacctttaggctttccaagtgaattgtgactaattttttcaatcttacatagatctttcacccattagcattacttacgtagataattctttatgcctagttattatacatattaatttttaaggtatacatttaaattacacaattgttcattgtggtttgtatcccagaatgtgttgtgttttttaaaagatgcataatagctgaatgtatgcatgactttgaaagaagttaaaatggtgattttttttcacctcttgtacattttaaaaccaggccaaatctatttgccaagcagtgtatcactaataagaaaagcagtttttccttttattgcagtttttgtttatctgccatagaatttccttatactgtggcttggtattattcaagattagctatttcgctggtattacatctttttaaaagcctattataacatggttagcctataaggcagtgttggtccccttctaatattggcctcataaaggggttccactgtactttccgcatattactgtgttgttgttttcctttgtggatatataagcaaattgagcttgggtgatttttatggagacaataattagacaatactgtataattagttttacttaatagattatcatcttgtgagaagagatgtttaaacgtggtaaatcacttcatattacaaaacagttttacacttaatatgttaacattgggtgcaataatttagtagcattagctttagttacaaatataactggatctttctgctgacaacttaggttgtatgagttatgcttaaaagctttaaatctgatgtttcctgtacctgccacactatgttagaatgtgtccttcaaacatatcctcctgcaacttctcaaactgtactaaattgatatttcttgaagtctaactctgtgctaacagatctccattttaaatagaatacggttttaatttttgataagctgctgaattttaaagagagttttttggggccaccaaatattttggatcatgcagagaatatatattgtactgtagtaattttgtatttacatttgtatgatgtgacataatagatgtgaatgttaatcactgcttgactatgttaataaagttgtttaactata

SEQ ID NO: 32452 - DNA, 3028 bp, Homo sapiens
gccgggctgccaggagcagttccgccgggtttcactgtccgtgacttccttcggggcacctcaggcagcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggacagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaa

SEQ ID NO: 32453 - DNA, 4905 bp, Homo sapiens
gagcagagcttagggggtggggcctcggagccaggccatgtcggggctcctcaagaagagggccagtgggactgctggggtcgggctggaggggatctgattgggggaagcgtctggggactgcttggggcctgattgggggacgtcgcgaggatcggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtgaactcctta

SEQ ID NO: 32454 - DNA, 2271 bp, Homo sapiens
gagcagagcttagggggtggggcctcggagccaggccatgtcggggctcctcaagaagagggccagtgggactgctggggtcgggctggaggggatctgattgggggaagcgtctggggactgcttggggcctgattgggggacgtcgcgaggatcggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccacagtccctctttccctcctcaccctcttccccctgcgggctcccgggtctgtccatttgttactgtgctgtgctggggattggcgccgaggtggcgtgagattccacttgtgtag

SEQ ID NO: 32455 - DNA, 5122 bp, Homo sapiens
agagggaggcctttacgcatgccttggtggcggctttctgcacgtgtttctcagcccaggtttcagtccagcggaactggctacctcggaatcccaactgctcctttagggtgtcttccgcgattctccgagtggagttaggcgcctgccgacacttccctaaccttggaggcccgggacttgattttcatgaatgaacggagccgggactgactttgcctacggcaaagaaggaaaaacggtgccctactgtcttcagacgtcgcaaggatcaagaagatttctttcttcatgaccctgcccttgccagaatttcctgcgctgttccacctcattcaacttcagcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacaggtcgcctgacgagtccctctgccattccagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtgaactcctta

SEQ ID NO: 32456 - DNA, 5092 bp, Homo sapiens
agagggaggcctttacgcatgccttggtggcggctttctgcacgtgtttctcagcccaggtttcagtccagcggaactggctacctcggaatcccaactgctcctttagggtgtcttccgcgattctccgagtggagttaggcgcctgccgacacttccctaaccttggaggcccgggacttgattttcatgaatgaacggagccgggactgactttgcctacggcaaagaaggaaaaacggtgccctactgtcttcagacgtcgcaaggatcaagaagatttctttcttcatgaccctgcccttgccagaatttcctgcgctgttccacctcattcaacttcagcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtgaactcctta

SEQ ID NO: 32457 - DNA, 4949 bp, Homo sapiens
gagtacgggagccgcggcggctcacctacggccgcgtttttcttttttttttttctttctttcttttttttttttttttttttttttaattctctctctttggctccctccttccgcgcgagtctctggagaagccgcagcgcgagttgccgccgctgctgcccggggccggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacaggtcgcctgacgagtccctctgccattccagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtgaactcctta

SEQ ID NO: 32458 - DNA, 5226 bp, Homo sapiens
gggcagagtgtcgggggaaggggactcttcagggactgtgcctgcatagaagagaccacgggggccggggcgctatcacggtctggggcggggcccctggatgtggaggcggctgggccctcgcccagccgctgcgagggaggtggaagccttcgggctcggagccggggtcagcggcatgggccaccctgggacgagggctcttcgctgggtcccatgaggatccgccgggccccgccgccgccgcctgtggcccgtttccacatcccccctcccgcgctcccgagcccgcgactgcgcggccgaggatggcgcagctggcggggaccccgcacttgggcgggcgtggatcggaggcctccgcctgtccgccgagggcgttcccgtcgtcatgcggccaccgcggcctcaggggctccacctgggtctcacacggagccccagagacccagcgctgaccccggcccctacctccgcagcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtgaactcctta

SEQ ID NO: 32459 - DNA, 2671 bp, Homo sapiens
agagggaggcctttacgcatgccttggtggcggctttctgcacgtgtttctcagcccaggtttcagtccagcggaactggctacctcggaatcccaactgctcctttagggtgtcttccgcgattctccgagtggagttaggcgcctgccgacacttccctaaccttggaggcccgggacttgattttcatgaatgaacggagccgggactgactttgcctacggcaaagaaggaaaaacggtgccctactgtcttcagacgtcgcaaggatcaagaagatttctttcttcatgaccctgcccttgccagaatttcctgcgctgttccacctcattcaacttcagcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccactccatctcaaaaacaaaacaaaacaaaaaaaaacaaa

SEQ ID NO: 32460 - DNA, 3245 bp, Homo sapiens
ccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaagggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaa

SEQ ID NO: 32461 - DNA, 3771 bp, Homo sapiens
aaaggtatcggtgctgtcgcttccggtccgggtaaacgaaccttaggtacactggtgtgtggcctcccaagataggcttctgagggcaagtcagcgactgaagacgggagcgccagaatctgtggactcaagagtctagaatcaagtggaaaaaccggaaaaaaggccaggaacctgaatacgacctaatagctgtttccgagggggcaacttccacggagagccttctgccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccaaagaagccctttagcaatgctgtgtgtcgtcacagcctgttatttggccagaatataacctctgaaatcagtaactgtgagtacttaccgcctgtactcagggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaagggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaa

SEQ ID NO: 32462 - DNA, 3019 bp, Homo sapiens
gccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccaaagaagccctttagcaatgctgtgtgtcgtcacagcctgttatttggccagaatataacctctgaaatcagtaactgtgagtacttaccgcctgtactcagggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaagggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccagg

SEQ ID NO: 32463 - DNA, 3283 bp, Homo sapiens
aaaggtatcggtgctgtcgcttccggtccgggtaaacgaaccttaggtacactggtgtgtggcctcccaagataggcttctgagggcaagtcagcgactgaagacgggagcgccagaatctgtggactcaagagtctagaatcaagtggaaaaaccggaaaaaaggccaggaacctgaatacgacctaatagctgtttccgagggggcaacttccacggagagccttctgccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaa

SEQ ID NO: 32464 - DNA, 4816 bp, Homo sapiens
taagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctgggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggt

SEQ ID NO: 32465 - DNA, 5098 bp, Homo sapiens
gaaagaggagccggaagtgtggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgc

SEQ ID NO: 32466 - DNA, 3400 bp, Homo sapiens
aggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggaccaggagtcttcttgaatcccatgagctctgcccaggaccctctctcaagcacctgtggcataccttcatgtgctccactgcacccagagcttaagccacagtcctgctcaggctacacctccaagggtgggaccaggcccaccttatcttcctgtactccagaggcccaagtcagccatgctggtgtggtccaagcttctgtgtgaaccctggcccttccatcagacagcattaccctttgtcctcctctagccccaagctcccagaagcttctgccaggcacctcagagcaccagctcccctgtcccagggcctaaccacagatcctggagttctgcaacctccagaccagagcggtctcatgaaccacctccccttgaatatcacataccacattgttatcaattcatcagtaaggtcagatgctgtttgcacacctccagcaatagggtgctcactgcctctcactttccaatggcacagattacaaaagtaaagaacaaccacca

SEQ ID NO: 32467 - DNA, 4272 bp, Homo sapiens
ggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctgggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaaga

SEQ ID NO: 32468 - DNA, 4644 bp, Homo sapiens
gtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatata
